United States Patent 7,745,391 (HUMAN THROMBOSPONDIN POLYPEPTIDE) - sequence listing, part 25

SEQ ID NO: 60052 - DNA, 2464 bp, Homo sapiens
ctcgtgggaaccggtgtcgcccggcttgggctcccggctcacctctcgggtgtgcggcaggggtctccgccccggggccacgggaggggaagcaagggcctcgctgtctcgccgcacctggggaagggacccaattagcgcggaccccacagcgcagcacctcaccagctccccgcaccaacgccccggcgcgctctttgaggaaaaagcagagggcgacttagggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60053 - DNA, 2490 bp, Homo sapiens
agactccgggccggagcgggagcgggggcgggagaggccgcggggcgggggcggggccagcccgaggggatttctctgagccgctgggccggaaaccaagtccgagcgtggctggcgcgggaaagttcgggaacgcgcgcggccgtgctcggagcagcgccagggcacggtccggggttttgcgcggggtcgcggctcccagtaccgcctgaggcccgtgggcggcccacccggccctgccccgtcccggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60054 - DNA, 2406 bp, Homo sapiens
agatgactgcagagtgagagtgaaaccagcttccctcggaggctgcagcacagggctgacatgcaaacgtctgaaaaagaggcaagctctcggtgtgagcaagtggactgcggctatttgaggaaggagcccacgtgggaatcccctgagctgcgccatggccagaggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60055 - DNA, 2598 bp, Homo sapiens
tagagacagggtttctccactttggtgaggctggtctcgaactcctgacctcaggtgatccacctgccttggcactcccaaagtgctgggattacaggctggtctcgaactcctggcctgaagtgatcctccaacctcagcctcccaagtagctgggattacaggttgaatcgctcctagctgacccctcacgtctcttatgatacgtacagaaagcaagagcagcccatgccgtccggccgcgcaccaggtctcagtctgtgtgtctggttcaggtgaccatggtgttcagttcagttcctcctgcctcgtgtgtaggccactgagagctccctagtctaagccggaggaggttctgggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60056 - DNA, 2235 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccgctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60057 - DNA, 2076 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggagggggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctctctctgtggtcagtggcatccatttgattccaggttgcctgcggcttccagccttggcagtggtgaccctctgcgggtcctcctggcctctcctctcacagacccctccccacggggtgctagcgcctgcctgcttctctagctagccaggcgtgtgttctct

SEQ ID NO: 60058 - DNA, 2211 bp, Homo sapiens
  misc_feature (23)..(23): n is a, c, g, or t
  misc_feature (62)..(62): n is a, c, g, or t
  misc_feature (72)..(72): n is a, c, g, or t
  misc_feature (82)..(82): n is a, c, g, or t
  misc_feature (106)..(106): n is a, c, g, or t
  misc_feature (110)..(110): n is a, c, g, or t
  misc_feature (125)..(126): n is a, c, g, or t
  misc_feature (136)..(136): n is a, c, g, or t
  misc_feature (143)..(143): n is a, c, g, or t
  misc_feature (165)..(166): n is a, c, g, or t
  misc_feature (172)..(172): n is a, c, g, or t
  misc_feature (190)..(190): n is a, c, g, or t
  misc_feature (193)..(193): n is a, c, g, or t
  misc_feature (197)..(197): n is a, c, g, or t
  misc_feature (205)..(205): n is a, c, g, or t
  misc_feature (221)..(221): n is a, c, g, or t
  misc_feature (227)..(227): n is a, c, g, or t
  misc_feature (231)..(231): n is a, c, g, or t
  misc_feature (239)..(239): n is a, c, g, or t
  misc_feature (260)..(260): n is a, c, g, or t
  misc_feature (287)..(287): n is a, c, g, or t
  misc_feature (302)..(302): n is a, c, g, or t
  misc_feature (307)..(307): n is a, c, g, or t
  misc_feature (342)..(342): n is a, c, g, or t
  misc_feature (347)..(347): n is a, c, g, or t
  misc_feature (363)..(363): n is a, c, g, or t
  misc_feature (365)..(365): n is a, c, g, or t
  misc_feature (385)..(385): n is a, c, g, or t
  misc_feature (395)..(395): n is a, c, g, or t
  misc_feature (415)..(415): n is a, c, g, or t
  misc_feature (421)..(421): n is a, c, g, or t
ctggctgctcgcttgccgctgcncccccctggttccctggtgttgctcctgctcggcttctncttgctcctnctgggcgtcntcgctggtctgctccgttcttgtnctcngcttgttgttttgtnntctgctgttnttttttntgttgtgtggcccctggttttnntttttntgcttggtttgtttcttntgntttnggcttttnttctgtgttgtttgtntttttntggntttttttnttgttggtttttttttttttntttgttgtttggttttttttgtttttnttgttcgttgtggtngtgtncttgctggttgtttgttccgttatggttgtttctngtggngttttgtttttttttntnttctgttttgttggttgctncttgtttttnctgtttgtttgttttgtgtnttatgnttgtgtttgctttggtgttttggtgcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60059 - DNA, 1671 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatgccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60060 - DNA, 1143 bp, Homo sapiens
cacgaggctgcggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaactgccccctactggtgtctgggggttgggggcagccaggcacagccggctcacggaggggccaccacgctgggccagggtctcactgtacaagtgggcaggggccgcgcttgggcgcttgggagggtgtcggcctgcagccaagttcactgtcacgggggaaggagccaccagccagtcctcagatttcagagactgcggaggggcttggcagacggtcttagccaagggctgtggtggcattggccgagggtcttcgggtgcttcccagcacaagctgcccttgctgtcctgtgcagtgaagggagaggccctgggtgggggacactcagagtgggagcacatcccagcagtgcccatgtagcaggagcacagtggatggccttgtgtccctcgggcatgacaggcagaaacgagggctgctccaggagaagggcctcctgctggccagagcaaggaaggctgagcagcttggttctcccctctggcccctggagagaagggagcattcctagacccctgggtgcttgtctgcacagagctctggtctgtgccaccttggccaggctggctgtgggagagggtctggtcccacgccgcctctgctcagaccactgtgtgggaggtgcacagcacagcctgcgggtaaagtgtgagagcttgccatccagctcacgaagacagagttattaaaccattcaaatctc

SEQ ID NO: 60061 - DNA, 801 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacgggttttgctgtgtcagccaggcagggatgcagtggtatgatctcggctcactgcagcgtcaacctcc

SEQ ID NO: 60062 - DNA, 796 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtgagtcggggggtctgaggttgggggccacccctcatcctgggtgtggtcttcactgcctc

SEQ ID NO: 60063 - DNA, 761 bp, Homo sapiens
ttagttccgggcgcgctgcgaccgttggggctttgttcgcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaaggtgagtgtccttcacctccttggaggaccgcagggcggggcccatgtgttggacgtgagggtcccgtgggtgggggtggggcaggttatgacccttgtgccc

SEQ ID NO: 60064 - DNA, 428 bp, Homo sapiens
gcgggggtcacagctctcatggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcaggtgcatggggcctgcaggctgggaggaggggcaggcaggctaggctggttttagagccacgctgcccagcctggtagctcccagcagagccgggtccagcttagatgtgctccagttatcgatactccctggatttcggaggtttaccacaaagaatgtaaaattaataattttaaaatagcaatttgaaatacgattttggatacatggggttaaatatag

SEQ ID NO: 60065 - DNA, 376 bp, Homo sapiens
gtgcctgctgccaaggccttcagcagggaccagaaacaaaactcacactctttcttctctgagttgagactggaaaaatgaaagattgttttaggggaaacttgagggaacagtctgggcagcctgcagggcatggccctgttcctccagggctgggaaagtcagcactgctttctggtggcgaccttccctctgcagctgctggctcagccgattgtatatgctgggagctctgcactaagcgttgggtgaagggtcagcattgtggaggccctgccacggaggtggtcttcttgggagctgcactcaggcaagaggacctgtttgtgtggaacatctgctttaagcaatgctggtgaacacagcttgtgtgcgg

SEQ ID NO: 60066 - DNA, 1561 bp, Homo sapiens
aaaccctctgtaaagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtagcctccgtcatctcttctgggatacatggatcgtggggatcatgaggcattcttcccttaacaaatttaagctgttttacccactacctcaccttcttaaaaacctctttcagattaagctgaacagttacaagatggctggcatccctctcctttctccccatatgcaatttgcttaatgtaacctcttcttttgccatgtttccattctgccatcttgaattgtcttgtcagccaattcattatctattaaacactaatttgagttcatcttgaat

SEQ ID NO: 60067 - DNA, 1450 bp, Homo sapiens
aaaccctctgtaaagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtctcacctccatttgcaattgacctcttctgggaacttcctcagatggacaagattaccccaccttgccctttacgtatctgctcttaggtgcttcttcacttcagttgctttgcaggaagtgtctagaggaatatggtgggcacagaagtagctctggtgaccttgat

SEQ ID NO: 60068 - DNA, 237 bp, Homo sapiens
gttaaattcctctcctgaactgttataaattttccctctgaatataattgaatgtctgcttgtaagtgtctcaaacaagttatacttctagaggaaaggattcaaaatcaattcatgttaactataatataaaacaatatgaaatggattaatattagggagagctatgaatcaagatctctactggaagcataaagacagattgatcatggttcaggtcatgttattgtggtaaga

SEQ ID NO: 60069 - DNA, 336 bp, Homo sapiens
aacagaatgtaaaaatacgcaagtcaaaacctggtagaactgcatggagaaacaaatggattcaatattattagtcgggaaattcaacgccctcctatcgaaaatggacagatccagcaggcagaaaattagtaaggacattgttgagctctgcaataccatcaatcaactggatataatggacatctatagactacttcaacaacagcagaagatacattcttctcaagctcacatggaacattcacaaagatagaccacacccaggcccataaagcacaccttaacaaatttaaaataatataaatcatacagtgtgctctcaaaccacagtga

SEQ ID NO: 60070 - DNA, 488 bp, Homo sapiens
gatacactaaaatatggaaatgtctttatgttataaaacatagtcatatctaaaatatgagctccagcctggagagaatttttgtgtgaggggagaactcagttaaagatcagggctttctgcctgttttgtagatcttaaagtttataagtagatttccagatgttatactatcaaactataacttgagttcagttcattaaaatttcgttgttgatcaggaccctcaactgaatttccaaattatctctctcttacatattcattttaatggccttttggcagcctgcgtcttgcacttgcagttttattgacagacatcatcctttaacacaagattttttgaaccctgaaccagcacatgcaaaacaagacatgtgcctttctggaaaaccagggctcgccaaaagaatggctggcatagcctcccaatcgcaatcaaacccaagaatcttttaattatgcaacagatatgttaaaaaataaaa

SEQ ID NO: 60071 - DNA, 1350 bp, Homo sapiens
tccatttctagattgcccagaactaggccacggcagctgggttctgagcaagacagtgaggttttcccttccgaccagggtgtcaagaagaattgtatgcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagagaacttccttggaaagtgtgtttcctccttcagagaatgttctacagcacttaggaaaaagtagtaataacaagatgatgtaattaaataggctctataaatgggctaagctgttaaaatattctactttatatccctcctttaaaatctagcaacagttgtctatacaatattaagatcttctctatatatttaaagttaaaatataatttttaataagtttttaaatttttttatttcaattttgttacttagaacattaagatgcatatttgtgatctaaagaaattgtcttgtccattttaaaaacctttattaagtcacttttaaaatgtattgaccaagaaggaggtttgttgttacatcaatgtttgtgaaatgatttccatacataaaaaatgtaatttacctgaactttgtcttaagactcttacattggattataggataacagataaataaactgtatagatacattcagtatcatacaacattttggaatgtgtatgctttcaggcttccaagataattaaattactgtcatgatacatttcatgcattttttatgacttcagtataaaacattcaggtgtgttagccttgcctgggaagggtaaacttgtatgtgctttggtaaagtacttaaattccaatgttccctatagtgcttgcattcattttgtgaaaagttttgttgtattgttagaacaattttcaaaggctgattttatgccttatctgatagaaatatagaatagatagttctttaattgcttactttttaaaagtaatataatatttaagttgcatttttattaatagtaagattaacatttaagtctgcattttctttaaatgttttaaatgtttatagcattcaatgtgtagttggatttacttgactaaaaattagccctttaacgtttatatttgttgtatttatatttaataaaggcatctaatctttagtaaaaaaaaaaa

SEQ ID NO: 60072 - DNA, 818 bp, Homo sapiens
tccatttctagattgcccagaactaggccacggcagctgggttctgagcaagacagtgaggttttcccttccgaccagggtgtcaagaagaattgtatgcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagaggtaaagtaatcatattcttttgtatttgaatattacttaaaatttataagctattgatttcattttctttttacataaaaaacatattaaatttaaaataataatataatcacaaaataatatgaaattttaaaacaagcatactgtaattagttaactactaaggcaaaactaattaccctaaaattgactggcttaaacaacactcataaactcacagtttgcagatcaggattcaggagtgacttagccgggtagttttagctcagggtttttcatgttgcagtcaagatgttggcctggactgtagtcattcagaggcttccctgagaccagaggatctgcttctcagggggctcattcacatgtctgttggcaagaggcctcagttcctcaccacataggctcttccataaggctcttcaaatgtctttgcatcatggcagct

SEQ ID NO: 60073 - DNA, 1671 bp, Homo sapiens
  misc_feature (755)..(755): n is a, c, g, or t
ttgcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaaggtgagcgcggcgcggaggagtggggcgcggctgcagccaaggcacctgccagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaacnggttgttccagtaggtatcctgctgcttgtagttctaatgaaagatcaaagtgctgtacccataggttaagtgggactttgcagttttaaacacattgataactagatagagatcttttgatagtatatatagtattagttatactaatagctagtatgggctattacttgtatatagttatagcgatagctattacgtatatggcactgattatgtgccaagtactattttacctgttttatattaagtcatctaaacttccacatcaaggtaagcacatgtttttatctccatttaactgataatgaaattgaggcagaggaaggtttagtaatttgtttaaggtcacatagctaataagtggcaaagcaaggaatttcacccaggtgttctggctccaaaatccttgcttctggccagtacactatactgttacatttccttcatcttccagtttcgtaatgtccaaggatatcattatatttttgttgtgttaacccaatgcttttcaaaaccataccatgtgagtggtgtacattttcaagctcccaatatcacgaaaatgtggtgccaggattggatgtgtagaactcagcattcagattgaagaaaaacaaaatcattgaccaaaagtgcttataaccagatatacttataactaataggttaagtggagaataatttcctgaagagatgatattctccttccatataggactgtgggatcttcctgctaaatcctcagttgctttgaagagctgtaattgtgaataatcctctcagatagcctgagaattcaattttggctaatgactatataccattgcaataggtaatcttcgataacatagccatattaaaaattccctaaaagcaagactctttctcactttaagtctcactgtctataacgca

SEQ ID NO: 60074 - DNA, 492 bp, Homo sapiens
ttgcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaaggcatgatatctctgtcttaggagctactaaattgagcctgcctcctgttgctgaactctcgttttttggattgcaatgtggtggaattgcaggatatcaagacaggccggttaaaaaggttttctctcagtttagtctctatcagatgcagtgccaagtatct

SEQ ID NO: 60075 - DNA, 1619 bp, Homo sapiens
  misc_feature (703)..(703): n is a, c, g, or t
ttgcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaacnggttgttccagtaggtatcctgctgcttgtagttctaatgaaagatcaaagtgctgtacccataggttaagtgggactttgcagttttaaacacattgataactagatagagatcttttgatagtatatatagtattagttatactaatagctagtatgggctattacttgtatatagttatagcgatagctattacgtatatggcactgattatgtgccaagtactattttacctgttttatattaagtcatctaaacttccacatcaaggtaagcacatgtttttatctccatttaactgataatgaaattgaggcagaggaaggtttagtaatttgtttaaggtcacatagctaataagtggcaaagcaaggaatttcacccaggtgttctggctccaaaatccttgcttctggccagtacactatactgttacatttccttcatcttccagtttcgtaatgtccaaggatatcattatatttttgttgtgttaacccaatgcttttcaaaaccataccatgtgagtggtgtacattttcaagctcccaatatcacgaaaatgtggtgccaggattggatgtgtagaactcagcattcagattgaagaaaaacaaaatcattgaccaaaagtgcttataaccagatatacttataactaataggttaagtggagaataatttcctgaagagatgatattctccttccatataggactgtgggatcttcctgctaaatcctcagttgctttgaagagctgtaattgtgaataatcctctcagatagcctgagaattcaattttggctaatgactatataccattgcaataggtaatcttcgataacatagccatattaaaaattccctaaaagcaagactctttctcactttaagtctcactgtctataacgca

SEQ ID NO: 60076 - DNA, 1119 bp, Homo sapiens
atgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctga

SEQ ID NO: 60077 - DNA, 658 bp, Homo sapiens
agcggaactatagtagaatatttaaatattttaatttctcattgttttatttgttaattggattgtaatttgccatcagattctctgtattatagaagctatcttgcttcttcaataagaggaggaaaaagaatctcacaattcccaatataatctttaacaactgtacgttaattgtaccattttaccttctaaacattatttactggagctcagttagtctttaaaacaattactcaggcagagtgtggcaaaagttcagcaagatcaagaaaagtatttaagttattgactgatcatagcactgttatttgtcattgcatgtgtttttccccctcatgtttctatgtgtgctattgatacccaaggaactcaaaaatacttaaaatattggtatacttgatgatttttctgaaaatcttatatttttcatattacaaattcttgagttctttatctttttcaagtctaattttgtagtggtaaaggctttgcacttaacatccttttgtgttcctttttaacaaggaaaaacagaaaataatggaattccatattttttacaccatggagtagtaaaattattttatatattgttagtacttcaacaaacatccctctgctaagtcagacaaaatccttatacagtaatttgtga

SEQ ID NO: 60078 - DNA, 437 bp, Homo sapiens
agatgcttgatggtcgtctctagcaggatcccccgacggtctgtacccaagaaaagtatttaagttattgactgatcatagcactgttatttgtcattgcatgtgtttttccccctcatgtttctatgtgtgctattgatacccaaggaactcaaaaatacttaaaatattggtatacttgatgatttttctgaaaatcttatatttttcatattacaaattcttgagttctttatctttttcaagtctaattttgtagtggtaaaggctttgcacttaacatccttttgtgttcctttttaacaaggaaaaacagaaaataatggaattccatattttttacaccatggagtagtaaaattattttatatattgttagtacttcaacaaacatccctctgctaagtcagacaaaatccttatacagtaatttgtga

SEQ ID NO: 60079 - DNA, 486 bp, Homo sapiens
ttttttttttaagtctagtgatctggcagaaagaattcaatagggataatatgttatagggtcaaaagtatctataaatattatgaagttgtatcagatagacaaatgatgtgttattatccctattttagagtattctgtaaaaaaaaggttaaacatctttcatttcaaattgtaatgtaactgtaacgtgaacaccactaatggccagaaattatctcaggcatcatgagactccctctctgtcacctctgagattagcactaagctttatccagcttgctggtgggacatttttacagtccacttagacaacttagcttcactaataattttaggatcttttattagaaaataaaaatctagcctcatattctcaaagcactattttatgagggatctaaggctatttttcaggtcggatgattactgcccctggctctgtaaaaattctttttgttgagaaacctttgtaaagttgtattt

SEQ ID NO: 60080 - DNA, 360 bp, Homo sapiens
atacaacacattttgaaatatgtatacactgtggaatggttcaactgagctaattaatatatgcgttacctcacatacttattgttttttgtagtgaaaacacttaacatggactcttagagattttcaaatacaatacattgttattaactatagtcccatgctgttgaaattattcctcttacttagctgacatgttgtgtcctttgaccaatatctcatagaaagattagtgatcattgtgtgtcatccagccttccattttattaatggtagatatatttttctttcccctgccccaccatttaggttaggggcatgtatggatgcagatggggtgtggggagaccttgtcttttt

SEQ ID NO: 60081 - DNA, 344 bp, Homo sapiens
accaagttctgttcctcttaattttcaagtgatagtttatttttcttaagcttatgttcctatattacaatgctttttaactgattcatactcttgaatgaatagtaaaaattgcttttcaatgttaaatcacgaatacatttaaacatgcatgtatttcttctattaaacacaatacttataataaaactggacgttaaatgaatattatatctaagaatgacctcttcctctgactatctccttttatgtcttgatgagacactgtactgaaaagatgtgcccataccttggggcatttgatcaagtgctctgaatgcatgttgctatagtgtgtagtttgt

SEQ ID NO: 60082 - DNA, 455 bp, Homo sapiens
catttgaatcatcttatatcatcacaagaagaaaggtgaatacacaataagatattttgagagagaaaaagagaccgcattcacctaatttttattgcagtatattgtgataattgttctattttattattggttattgttgttaatctatactgtgcctaattcataaattaaaccttatcatatatacaggaaaaaacatagtgtatataaggttcaatactatccttggtttcaagaatccactgggggtcttggaacatgtaaggtggtggggggactactgtatacttaaacatttaaaaaatttaaacttgtcatatgttatttgttatatttaaactgtattatatttcgttgtattaagactcattttggcataagaacagaattagaaatagtaacaggtagcattaaacactcaccaggcactgttttccttctttacaagactc

SEQ ID NO: 60083 - DNA, 2184 bp, Homo sapiens
gtgagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaatgagcgtg

SEQ ID NO: 60084 - DNA, 2134 bp, Homo sapiens
gtgagacaggggtagtgcgaggccgggcacagccttcctgtgtggttttaccgcccagagagcgtcatggacctgggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaatgagcgtg

SEQ ID NO: 60085 - DNA, 576 bp, Homo sapiens
gtgagacaggggtagtgcgaggccgggcacagccttcctgtgtggttttaccgcccagagagcgtcatggacctgggtgagtgagcctcttcatgtgagaaggaacagtaccagggtcttggacacccagactgaccctgtggaatgggggtggaggatgcgggtggagcgcataggggtgcttcctggagaaatcagttctgatttggtgggcattggaagctacttccagagaatgccccctgctgtcccaggaggggtgcacctgccctttcagacctggagaaggggtcagcctttggtgccagtggggacaagggaggggccgagatcatgtctttctcagcagggacataagagagtggcggggctgggcttggtggtctggcagaacctgttctcatcatgagggtgataggttaggccctctgggacctctggggacaggtttcaacagagaaattctccctagagagcttaggaccttttacccactctctgattcccacctttctcccctgccaaatattcatatacctgtccacttggggtcatgaggagatgcatgcgtgactg

SEQ ID NO: 60086 - DNA, 3268 bp, Homo sapiens
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 60087 - DNA, 3190 bp, Homo sapiens
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 60088 - DNA, 3586 bp, Homo sapiens
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggtgggtgtggcggacgaacgccagggctcccgcaggtggagaggaaggcctaagcctgtggtgggggtggggaagggaggcagggagggtgcctcctcctcccactcaggcctttgctgtcttgcatgggggtctgctcaggggacgccaagcccaagaggctcaccctcctgtaccctggggcctgaagtcacctgcggggggctgctggtggcagggtagggggagctgtaggcaacaaactggagcctctggtccttcggggcaggaccaggccactctgaagcccacagcacacccggctcccactcccctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 60089 - DNA, 3368 bp, Homo sapiens
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattgggtgaggcggccaggccctgcagagccagggtatgctggaggtacgaggtgggtggggaaggggccaggccgcctcccccaatgctgccccgcctccccagctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 60090 - DNA, 1126 bp, Homo sapiens
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggtgggtgtggcggacgaacgccagggctcccgcaggtggagaggaaggcctaagcctgtggtgggggtggggaagggaggcagggagggtgcctcctcctcccactcaggcctttgctgtcttgcatgggggtctgctcaggggacgccaagcccaagaggctcaccctcctgtaccctggggcctgaagtcacctgcggggggctgctggtggcagggtagggggagctgtaggcaacaaactggagcctctggtccttcggggcaggaccaggccactctgaagcccacagcacacccggctcccactcccctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaaggtgggcagcggtcctggctgcagaggtgccagagcccctggcgggaggtgggggggggtgttg

SEQ ID NO: 60091 - DNA, 665 bp, Homo sapiens
gcgaggtctgtggggagcttcgttccaggtccagagaaggtgatgtccaggctagagccgggactgcctgggggacccatgtcagctgtgtctgtttcctcccaggtcatcaagccaacgttcgcacccccagtgcccccagtcaaacccggggctggtgcggccaaccctggtccagctgaggtgaggccccagcacacaccaggcagagtccactgtgcaatggacggcacggcctccccacggggctgacagtggcacggcctccccacggggctgacggtggcactgccctggagggtggggtttttttctgattatctgtggataaacttgggtgactgaaagaaaagggaaaggcattggcagtggctgtactgtgatatctgtgctgtgatcaggggacttctcagcagatgccgaccccggctgtcagtggtgcctgaccttcccccagcaactgcagggaagaaagtctgtcctctgtgagctgtatatactgtgactgccacacctgccattgtgtgcatgggccatgttgttggtggatgaaccaagaatccacattttaagagatgttaaaggacgtaaaatttcgttgtaccctttatataccttttatagcaggtagtttttcaacatcagttatcttttcctcctcccag

SEQ ID NO: 60092 - DNA, 3463 bp, Homo sapiens
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggagggcagttccggccccagccctgtccttacctcagcatccggggaacctactaccgacctgcccgctgccctgggctcatccagccggtggcacagctaaggctgtcccagagctctgcaggccgagccccagcctgcacatgggggctggagatgcagtggtccagcaggaggctctgcaggcaccaccagggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 60093 - DNA, 3581 bp, Homo sapiens
cgcggggctgtcacctccgcctctgctccccgacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttctaccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggtgcgtccatgccccatacctgctcccgtcagcactgggtgccacaacctctgtcccttcaggccagggtgaccactgcacatccacacgtggaacttggggctctgtgggtgtccagagcggtcacagggagggagtggctgcagggcaccccagtggtcaggggaggcggccaggtccgccctggagcccagcccggccccagtgcagcctgccaaggcctttgccgtcgccccaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgaagtgggcacagagctggcctggcagggtggctgcaggccttgccagggctaacccgctcctggtcccacaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 60094 - DNA, 2339 bp, Homo sapiens
  misc_feature (1)..(1): n is a, c, g, or t
ntagcaagaaacaaaacacaaacaacagaacaagaacacatacgctagtactgagcctggggtacagagaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctgcgtgctcttcgagagggtgtcagtgagcagactgcaccccaagctcccgactccaggtcccctgatcttggggcctgtttcccatgggattcaagagggacagccccagctttgtgtgtgtttaagcttaggaatcgcctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 60095 - DNA, 188 bp, Homo sapiens
attcccaacccctccccatgacagactgatcacacctccttcctatactacttctgttctttgtaaatacttagtattttccaagggagtgggagagaagaaatgctaggttcatgaagggtctctaggttaaactttctttcttttttttttcttaaaacaacacacttattatcttacaaatctgt

SEQ ID NO: 60096 - DNA, 241 bp, Homo sapiens
ttttgccatgttgcccagctggtcttgaactcctaggctcaagcaatccacctgcctcaacctgccccgatacagatttttaaaatgtaggtgattaataactcacttgtagctctggagctgttcaacagaagttgcaactcaagaacgctatttagtaattaataagaaaagtttggggaaacaaagttctacattgtgctctgctgatctttttctttgaaatcttactgcagatgct

SEQ ID NO: 60097 - DNA, 448 bp, Homo sapiens
tgatcatagctcactgcagcctcagcctcctgagctcaagtaatcctaccacttcagcctcctgagtagctcggactacaggcccaaatcatttatttatttattttgtagagatagggtcttgtcacgttgtccaggctggtcttgaactcctggcctcaagcaatcttcccacctcagcctcccaaagtgctgagactacaggtgtgagccatgattgccagtccacgtcttagtttttaatctcccctgcatggctgagggcagaggccagccagggagcatctgaggagacccaaatttgcatcccaccatgggccagttagtagttgtgtgacctctggtgatgggcatcacttttgctgaggcctgctctgagggtgactgtgtggcctaaaggatagagggcacagagttcccactccagaagcgacacagcacatccctg

SEQ ID NO: 60098 - DNA, 851 bp, Homo sapiens
ggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctgggtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 60099 - DNA, 252 bp, Homo sapiens
gctcaaagaccctgaactctcatttgttgcactccaaagctcaaacaacgtcttcatctgacctcaacatgacatcatcactggagctcaatcaagcagccctgagtttacaattacccttctgtaaacctcaaacaacatcttcaagcctagatgtttgctggagatcactttcattgaagtctcatcaaagagtctcaagttcatcattatttcgcctccaaaatcaagaaataccttccataaacatca

SEQ ID NO: 60100 - DNA, 164 bp, Homo sapiens
cattcaagggacccctctctccagatgcccctctggcttcttccttttgcagttaatttccttggatttgtggaggttttccacttttaaaacttcagctgggggccagcatggaggcgctcccttccgctctctgacccctgacccctgtttttgttccaggc

SEQ ID NO: 60101 - DNA, 525 bp, Homo sapiens
cttgctgaaagattatatgatacagtagaactaaggtggggcctgagaaattgcatttataacaagctctcaggtgatgccaatgccgctcaaccatataaccatagtttgagtagtaaagttatatattctgtctgttctatcatattttaaaaattttggtctcagtataattatgcctacccacattctcatcccttaattccttctgtcattttctgtatacagttatgtttttttttatcatttttattttttcacttgtcctcagtcacttttaatgagataatgcatgtgaaggtgcttagcacacataaatattagctacaaattccttccatgttttctgtttttctactctttcttaatttatgaaagattgtttactttctccctttatattcctcttttaaaattccatttatggctggatgtggtggctcatgcctgtaatcctagaattttgggaggctgaggcaggcaaatcacttgaggccaggagtttgagaccagcctggccaacat

SEQ ID NO: 60102 - DNA, 507 bp, Homo sapiens
cggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttatt

SEQ ID NO: 60103 - DNA, 594 bp, Homo sapiens
  misc_feature (258)..(258): n is a, c, g, or t
ttatttcaggagtggatgttatgacagaggaatgtaggaaggaaggacatcaggctctgaacatccatccatgtaaaacattgaataagactagctgttaaacagggctttttccctagaaaggtgtcataattttgactccatcaaattcttctaacagcaagtactcatttgggcccattttacagaagaaggaaaactcttgagtggctcaatcttggctctccacaacctctgcctcctggattcaagcgattntattccccagcataccaagaagctgggattacagttttgaagatgaagaaaaaccgaagctataaggactgagataaaatgcccaaggacatatagcttgaaaaaggcatggctagaatgtgcactcagtatgacctcagcacccaagctttttaccaatatatgctgcaattttaggctcatcaactgcacacagtgaattgtggtgctacttcgtttaagcctgcattttccttcagagcctacacctccctttcagctgttttcaccttcactgttccaaaaaaagcagactttgaaaacttaagaaatgacattaaaaaaaatcaaaatcga

SEQ ID NO: 60104 - DNA, 562 bp, Homo sapiens
agaccttgaagtatcagggttcgagccccgagaggagatccaaggggaccccctcctccatctgactgaggaacggactccccacttccaccaacccaactcgtcatggctgctcggaaatctcatattcaactcaaaaaaggaggcgaaactcctctcaacgcctgcattttaagcagcggctcctcggctcttgtgcgctgttcaggcgctcgcagatcgtccctgctcttccctccaccctgcagtgagctcctggcagctgggccggacgcagcttcccatgagcagaggatcgacctgggagcctggtgggtgatctccgcccagaccaagcatgagaaccccaagtccagtgggacaggccacagaccagcgactgctgcccatgcctgtcctggggactccagacagtgccgagggaaaggagaaatcattcattcagccattcattcgttgacccaggcaattattcattcattcattcaacagatattgactgagtcctccctttgaggcaggcactgttttatgcactgaaatacaactatttatacaacag

SEQ ID NO: 60105 - DNA, 297 bp, Homo sapiens
ctcttttctttataaattacccagtctcaggtagttctttatagcagcacaagaacagactaatacagttcctttgaagaaaagactgagaacatgattacaacaaatatgccattgtattacagtgtttttgctgctacagaccttaccgttttttcagccaatatatttcagatgtaaaaattggatcaggtcctgatattggtaaaagaatcatgatttttgaattttgataactgtttttaaactcctgctacttcatttttgtcttttttgggaggttacagatgttaagta

SEQ ID NO: 60106 - DNA, 232 bp, Homo sapiens
accaccccatctgctggtggtgctcatacttctccgggatacctcccctccagtctcctccacccctacagggtcagcactgctcttaagccttgaagtgtcacatctgcatggcagctgccagcaaaagggagaaaaacctctgtatcccttcaggtgacactagttgctgtatggataaacacctaaatctcacttggctgaacacaataaaagtttatctggtgctcac

SEQ ID NO: 60107 - DNA, 960 bp, Homo sapiens
gctttttaaatgaccccaggcgtgtggagacattgcatgctgtgagggaaataaaaacaataatgcgaaaacaacgttaaggatctactccaagtatggcccacaaaacactcttgagctgcttgctgttgcgcccctgtgcgtttcatccctcctgctctcttcgtcaaccctacagcatgtggggtgtgaaatcacttgagaaactgtttccactggtttgctatgagaatttcatagtttgacccctgaaaatgaagggaattagaattgataggagggatgatttggtgcccaaagtggtgaattggtgccagaaggtcacctgagtaagaaatgcctttgcctggtggctacgtaagttagaaataagtgagctgaaaattaaagtaaaaaaggttaatttctatgagaatatcagttggacagacagcaattagataaggtacaatctaagaagtaaagcaggagagagagtttacttaataactaaatatttacttttatctctttcactcacttgtaaaccaagataagcctgtttgttttctatataagagttaatgctctatgattaattatattcattattccaataatagcaacaatgagctttaaatgaaaatcattgtcattatgtctatttatttcttggttgcaaattgaaaaaatattgaaaatcaaatggacattgtacattatttactaagaatatttcacttactgtggatgatttaaaaaaaaactattctgtttcacttaatgcttcaagtgaattacattttctgcctctcacatttgaatacaaggctgttatcttagggctcccagcactgtggaagaaacatttcatggaagtaactctatttcagctgtaatgtctctttctgctccttttttattgaagaaaaaaaaagaagaaaaagaaaagaaaaagaaataaagcaataataattatat

SEQ ID NO: 60108 - DNA, 302 bp, Homo sapiens
ctctgatgagattgaaagcaaaaaaatgaataaagcataaagttggttcttagaaaaaataaagaaaatgcatagcccagtaactagattaacctagaaaagaagagagaagattcaaataagttcaattagaaatgaaactgtagctcattgagcttgcctgcagctctcagggttcctgtgactttcttcatcgttggagccaggcctacatgccagcaaccatgtcgaagggacctgcagttggtattgatcttggcaccacatactcttgtgtgggtgttttccatcagggaaaagta

SEQ ID NO: 60109 - DNA, 480 bp, Homo sapiens
ggtggagaccagttccaggggcagggatctgggtatgaataaaagggtgtatgatgtgggtgggttgggataggcccaggagccaggattgtgggagatcagattcaggggtagggccttccttggatccctagattgttgatacagttactgccccatgttcatacaacccaataggatcagattatgtatgcacatttgtctataacttgctttcccaaggcagaacatagtgatttaacactaagagtttaggggagcaggagaggactgggtcatagatacacatataggaaaacttaagaatggtacaaagtcagtcaaatattctcccaccacggtctttcagttcttttgctcagaggcaaaaataattttctcctctatctttccagatatagtgtggacatgtatgtgtgtgtatgtgtgtatgccgtagtcatattcatggaataaatgctattacctcccccccaacaa

SEQ ID NO: 60110 - DNA, 719 bp, Homo sapiens
aactgcgaaaggtctttaaatgtcaagaataaagaagtccggacgaactctgctaaggtacaatttgtggtaaattgcctctccacctcccaatcatgtaatttgcacttcccagatggttaaggaccatggttccaccaagctctgtgttcattagaacatggtttcaagctgagatctccacgcaaaggctattcagtttcaattccaaccctgcctcaaattttggaactttgggcaatatttttacccacctcagcttccccttcagagaacaggaaataatctacattgtagagttgtttggagctggaactggtaaccatgctcaccaaagatttaatattagatttaatattatacaaatgctgccctctttctcctgctctcaccacatgactgacatacctgcccccattttgccttctaccatgattgtaagcttcttgaaaccctcaccagaagccaaggagataattggtgccatgcttatatagcctgcagaaccataagccagttaaacctcttttctttataaattacccagcctcagatatttctatgcagtaacacaaaaatgacctaatatagaaaactggtaccaaagaatggggcattgctataaagatacctgaaaaacttaaactactagatatcaagactccttaaaaagctacagcaattaagatagtgtgttattggtataaaaacaggtaagt

SEQ ID NO: 60111 - DNA, 385 bp, Homo sapiens
ggtctgtgctctgacatcagcttttccaagtccttctctgatctccacatctaggaaagcagcttgaggcactctctcctccttctgctttgcttttccgcagagcatttatctgtgttttatcagaatatatatatctgggtgctaattttctatctcctttgttagaattcagtttccactagcacaggttctttgctcagtactttatcctctgctcctagaatagtgctagttacatagtagatacttatttaatatttcttgaataagcaaaagaatactctcttgattatattctagtggttttattttattttattagtttttagagacagggtctcactttgtcacccaggctggagtgcagtggtacaatcatagc

SEQ ID NO: 60112 - DNA, 490 bp, Homo sapiens
cactaaagtacattgtgggccaggagctggctccagaaagagatgttcaaagataaagctgagtttcttcagtacgtattgtgttctctggcattggcagcatctaatcttgacgtggaagacacttggggagcccttgaatggctgtttcagtaacaagcttaatttcactcctcagcactggtgttttacagctgttgcagagtaagaagtgtcaacttcattggacatgaaggagaaatctcaaacagagcgggaagcaattatgtattcaaggtcaggcagagcaagaaacatgcatcagagcccccacctgagagaaccagccattagtcacagcgagtcacagcacaattgtccacgctgcaaaacctgacttaattggaatcaacaaggccagaacaaacttctgaatgtatgccagtctcttttcatgaagggactgtgcagtcagttagattggaacttgaataaatcgtttttttggaaa

SEQ ID NO: 60113 - DNA, 313 bp, Homo sapiens
aattttttttttggtctctccccctgtccagagtgaggttttggtagaagaattcacttctcaaaccctcagattcaataaaatcagaaacctctctattcccttcagagtataggcttttaaaatagaaaagaggctggtggccttcagtctttgtgcttgaggtctggctgcagccctgccctgaggcaatgactcaggctggtgggattgggcaaagggtgaaaagtggaggaaaaacccggtatccgcggtttggctttccatggttttagttactcatggtcaaacgtggcctgaaaatattaaatga

SEQ ID NO: 60114 - DNA, 462 bp, Homo sapiens
cgagactctgtctcaaaaaacaaacaaaaaaaagctcacttgtgcagggccaggttctaggaagcaccagggagctggggatgtgggccttatctttaaagggcctgcagtccacagtgggagcgggggagaccaggtatgtagcaaaacttatacttaaatagaatataagcaaacataaaataatataggacaaatgggtggcatgaacttatcatcaaaaaataccagaactatttcctgaagaggataaatttagagcaatgcttcttaaagcgtggaagtgtggtagcagccgtcctggggagcttatcagaagggccagttctcaggccccatcccagactcctgaatcagaaacactagggtggagtccagccatctgtgtgttaaccagctctctcagtgactctggtgcacactaaagttcgacaccccctgatttcagtggagggaataaca

SEQ ID NO: 60115 - DNA, 429 bp, Homo sapiens
gcacatgcacaaatatgtgtgtacatggatgttcactgcagtggtgttggtaaaagcaaataaacagcccaatgtccatcagtaaagggatggcttaaataaattatgatacagctaaaaaatacaatgaagattaaaacttatgtagatcacatatacacataagatttccatcaaaaaagcagaatatgtgcagcataattgcattttggttcgaaataaaactatatatgtattcatgtgtttatgtatagttaacagttttgaaatatatatatcaaactgttaacaatggttaccactgggcagtaaagaaggggctttcgtgttgaattttatagacttctatgttattttcatttttataaatgtatctaatttgtaatttttaataaaacaaaataaattcaaggacaagtatattagaga

SEQ ID NO: 60116 - DNA, 670 bp, Homo sapiens
cagcatgagagactgctggacttcagtcttcggagcaggcaagaacggggagcttctgtggatttctattcctgtcgcctgtcactgtgaacagtgcccagtactgctggtcagtaaatgtttgctaaaatactgagcaaccaaggaagtgacttcagttgaactctgtacctgttgtgttcacttcctttgcaacatgcgtgactaatggttactccttctcttgaatgcttccagaagagtagcactcaccacctcatgaggaaaggcactgcaactttggtcaatgatatctgttagaaagatcttttcctatatttagaagagtgattctcatacctgagcatgtatgagaatcagtgggtttgaggtgggcccaagaatttccctttctaacaagttcccagaagatgctgatgtggcagcttctagcacagtgcttggaaatccatgagttttcaagaggacaatctaaagtgttcctttgttttcctttacttcccctcattctcaaatcctatggggatgacacagagaaccacaaacaaaacaacacacacacacacacacacacacacacatacacacacagagcacccttgtccctagctttatcctctgggatacacaggacaagctcctccctgttctatgtgcaacttttaaaata

SEQ ID NO: 60117 - DNA, 1642 bp, Homo sapiens
tgcttaaatcgcaggtgcaactgccaaaagaactggcgtaagaggcaacagagccgtctagaagaacaagaaatggaaatagtgactcttggattacagcatggagactatgtcagcagcaatactttaggatccacgtggcagaactggaaacaatgctaccatctgataagggtatttgtaaaaggcagaatgtttgggccatgaagaagtaggggctgaagaggaaggtggaaggagataaaatataatatttagaggcaatattttctacttgcaatcaatttgagtgactcaggtgaaatttagagtcatatttcccgaagcagaagttaaagaaaattttttaaacatttgctttattattgttttcttctggtaaataataaatataacagaagtgttaactattgtattcccatttttttctccttccatctcttctgcggtaattcatcacatagtatcttaaagggaacaaataatgtttcatcctatggaaatgtgaaggatgaattgagctcctggcccttctgatgctttgaaatggaaggattgttccttagagcttctctgcagaatcagtggagattttcagtttcccaccctgcctggctttctctcttggtgactcccttggtgttttggagtattctttctataggggtacctgtgaggggcagaacacgtaagccacagaacatggtgaaaactaagtgtcactaggaaaagtaatgggaaagtaaaccctgcatatatgaaaacttcctggcagcaagttttcatatatagagggacaatgggagacagcatgctgtttttatagaaaagaagttttacataatatagttattgacaagcttttggttttggctaaatacacacacacacacacacgctcatatgtgtttactctgtaagtctaatttgattttatcactctcaaacatattttaaaggaaacttgcttacaggaaggattaaacttgaactacttatcctattctttaaggcactccattgcctggccccaatttactaatcctgtcttatttcccacaaatcctttatactctactcgatgaaacatccttgtgcacacccttgtgcctttgctcgcattaatccttccaagagacttccctcctgttctccattaatgaacgtcctacccagtcttcaactcccgggtcagatcctgtgtcctccataaaaaattttccagacaactccaatctgtccttcttccaagttcctagaggccttaattattcattctagccactaggtgcatagaatttgagatttttgtaataatagaagtagtgtgaaccctagaaattagaaaatcaagctttgggccaggtgcggtggctcatgcctgtaatcccagcactatgggaggccagggagggaggatctccagaggtcaggagttcgagaccagcctggccaacatggtgaaaccccgtctctattaaaaatacaaaaattagctgggcatgatggcaggcacctgtaatcccagctactcgggaggctgaggcaggagaattgcttgaactggggaggcagaggttgcagtgagacaagatcacgtcactgtactccagcctgggtgacagagtgatactccatctca

SEQ ID NO: 60118 - DNA, 1428 bp, Homo sapiens
ccactgcaacctccgtctcctgggttacagagtgagaccctgcctcgaaaaataataataataatagtaatttgagtgactcaggtgaaatttagagtcatatttcccgaagcagaagttaaagaaaattttttaaacatttgctttattattgttttcttctggtaaataataaatataacagaagtgttaactattgtattcccatttttttctccttccatctcttctgcggtaattcatcacatagtatcttaaagggaacaaataatgtttcatcctatggaaatgtgaaggatgaattgagctcctggcccttctgatgctttgaaatggaaggattgttccttagagcttctctgcagaatcagtggagattttcagtttcccaccctgcctggctttctctcttggtgactcccttggtgttttggagtattctttctataggggtacctgtgaggggcagaacacgtaagccacagaacatggtgaaaactaagtgtcactaggaaaagtaatgggaaagtaaaccctgcatatatgaaaacttcctggcagcaagttttcatatatagagggacaatgggagacagcatgctgtttttatagaaaagaagttttacataatatagttattgacaagcttttggttttggctaaatacacacacacacacacacgctcatatgtgtttactctgtaagtctaatttgattttatcactctcaaacatattttaaaggaaacttgcttacaggaaggattaaacttgaactacttatcctattctttaaggcactccattgcctggccccaatttactaatcctgtcttatttcccacaaatcctttatactctactcgatgaaacatccttgtgcacacccttgtgcctttgctcgcattaatccttccaagagacttccctcctgttctccattaatgaacgtcctacccagtcttcaactcccgggtcagatcctgtgtcctccataaaaaattttccagacaactccaatctgtccttcttccaagttcctagaggccttaattattcattctagccactaggtgcatagaatttgagatttttgtaataatagaagtagtgtgaaccctagaaattagaaaatcaagctttgggccaggtgcggtggctcatgcctgtaatcccagcactatgggaggccagggagggaggatctccagaggtcaggagttcgagaccagcctggccaacatggtgaaaccccgtctctattaaaaatacaaaaattagctgggcatgatggcaggcacctgtaatcccagctactcgggaggctgaggcaggagaattgcttgaactggggaggcagaggttgcagtgagacaagatcacgtcactgtactccagcctgggtgacagagtgatactccatctca

SEQ ID NO: 60119 - DNA, 417 bp, Homo sapiens
atcccaggtacctccagcttctcccagatacttttctcactgggccaccgagcccgtctcacttgggcagctacaggtcacctgctggctccaggccccccatgtgcgcctccgcatctgccagccttgaacaagcttactgtggaggtggacgaggccaggctgcaggtatcaggaagctctccttggccctggtggagagggagcaacaggggagcagtggccacagcgagacccatatgagcacctcagcggtggccctgggaggcggggacaagggggcagttgagaacgggtcaaaccttgtttactttaaaactcattagatacgttggataatatggcctgttctatttcttttgcagggagaaaattcctcttataatgcaaatcctgctaagccctgtttgttttctt

SEQ ID NO: 60120 - DNA, 1058 bp, Homo sapiens
cacagtcttgctcccatcagcacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaatgcataagatatattctgtcggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcacctgtagtcccagctactcgggaggctgaggcaggagaatggcgtgaacctgggag

SEQ ID NO: 60121 - DNA, 883 bp, Homo sapiens
aaatagagtgtccagcccaggaaagaaatgtaaaaatcccaaatttaatttatggattaagacgggggaatttggcagggcacagtggctcacacctgtaatcccagcactttgggaggctgaagtgggcggatcacttgaagtcaggagttcgagaccagcctggccaacatggcgaaaccccgtctctactaaaaatataaaaattagccgggcatggtggtgggcacctgtagtcccagctactcaggaggctgaggcaggagaatggcgtgaacccgggaggcagagcttgcagtgagctgagatcgcgccactgcaccccagcctggacaactgagcgagactccgtctcaaaaaaaaaaaaaaaaaagaaagaaagaaaaccttaaatgtttgtgttttgtttgtttgttttaggtaattcctactgtattcaaggcaatgcaaatgcaagaacgggacactttgctaaaggcgctgttggaaatagcttcttgcttggagaaagcccttcaagtgtttcaccaaatccacggcaagtgttgtgtgcagtgcaatagtctaggctgacaagtcaaatgttccaggtgtagaatagttgaaaaaagggaagcaaaaagcaactatcacttagtatgttttcactttaggtattttatcttactaaaccattccactttctatgtggtaggtttcattatctccattttataagtaaagtcatctaaattcagaaagacagggtaaatgacttcagattccacaggcggtgaagccagagttccaagctgggtctatttaacactaaggaacttccttgcctcccgctaaaaaccttagagaaactttccacatgggagggtggttttaagtcccgaaa

SEQ ID NO: 60122 - DNA, 2372 bp, Homo sapiens
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagtccattgcttcatggctgctttcataaggcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaatgcataagatatattctgtcggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcacctgtagtcccagctactcgggaggctgaggcaggagaatggcgtgaacctgggag

SEQ ID NO: 60123 - DNA, 1437 bp, Homo sapiens
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtacgtctatcctcacttcaaaatttatatgtcaatttacgtaagcagagcaatcacttcggagcctaaactatactaagcatgagttaactttatccttaacaagtacaacatgggatcatttaattgggggtaaaggatcaattatttatttttgtgtattacctaaaatataaaatctcagagccatatacttaaaatccaacttgaaacctctgtaggagataaaaattttcaataaaatctggctttggaactata

SEQ ID NO: 60124 - DNA, 2328 bp, Homo sapiens
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaatgcataagatatattctgtcggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcacctgtagtcccagctactcgggaggctgaggcaggagaatggcgtgaacctgggag

SEQ ID NO: 60125 - DNA, 1683 bp, Homo sapiens
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagtccattgcttcatggctgctttcataaggcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacggcaagtgttgtgtgcagtgcaatagtctaggctgacaagtcaaatgttccaggtgtagaatagttgaaaaaagggaagcaaaaagcaactatcacttagtatgttttcactttaggtattttatcttactaaaccattccactttctatgtggtaggtttcattatctccattttataagtaaagtcatctaaattcagaaagacagggtaaatgacttcagattccacaggcggtgaagccagagttccaagctgggtctatttaacactaaggaacttccttgcctcccgctaaaaaccttagagaaactttccacatgggagggtggttttaagtcccgaaa

SEQ ID NO: 60126 - DNA, 1195 bp, Homo sapiens
tgagaagggcaaatgctatcattggaaaaactgacaaaagtcccaataggaaaaataaggaagtggagagttactatgtttctaatttttcatgtgcttctatttttttcctacttcagagccattgactaatagttgagtataacacaggttgtgtttccgggctgctgaaacatgacactaatattttcaaagaactgtggaagcctaaaaggaagccaatgagaaataactaaatgagagtttaggactgcagccttcattttcattcaaagatttaaaagtttccataaagtaaaatgttcttctccggccacctgttttcatagttctgtgttttccttcaggcctttctggcttcctatatggcagtaagaaaatgatgtgcttaatgattacaaatttcatatggaatacgaactttcagtttgtacatatgatgcacagagatgcttttgtggttttattggttttcatattacaaacaaagaaactagaaaatgaaaccattccaaaagtggaagtaatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtctacctggccaggtagacctaacccaaaattgcttaacaataccctaaatccattttgagttcagagcagaaatccgtgttccttccaatctgctcagataaccaggaaatgctgtacctgctgggtctgcacgtatagctcccgacacaactgctactccagccggcatgagtcacccaagcaggcatagcaacggagtactagtcaaaccacggatacagcggctcagcagattgcactcacgcacacc

SEQ ID NO: 60127 - DNA, 553 bp, Homo sapiens
ggcagctctggctacaagggaaaacacaggggaatccatccatccatccgtccatccagccatccacccacccacgcacccactcactcattctaggtgctgggaatatatgtggcagtggccgggacacatgaagttcctaaaatctcatggagcacatgttgtggggaagtgggaagtgaggatagccacgaggctggcacagagtgtacgatgttgagggtggcagccccacgaggagaggtgaggcaggcagatctgctgtggcgtgaatggagacataggagcaaaggctcaaatgggtggaggaaggagccaagttgctgtcccagcacagggaaaggccagggacagacccagagggggcagtacttgagaaaaggcaagagggaaaggtggctaaagtgggatcgaggagagagggagagtgaaaagggggctctcgagggaactgtgagcctctggagagtctacagaaggagagtaatgtgaactgatgttttcaaaggctcaactggctgggcatctttggatatgcaatagcccaggcctg

SEQ ID NO: 60128 - DNA, 187 bp, Homo sapiens
gaaccgcctctgtttccagagcaactggtcaaaacctctccaaatattgagcagttttgaaaactggattaggaaccactaatgaaaaagaacagactcagggacaagtgtttggcgggaatgtgtgaagaggtaactaatgagtgtcactgaattccactattaaacagatgaaacaaagcctttc

SEQ ID NO: 60129 - DNA, 448 bp, Homo sapiens
aaaaattagccaggcgtggtggcgcgtgcctgtaatcccagctactcaggaggctgaggcaggagaatcgcttaaacccggaaggcggaggttgcagtgagccgagattgcgccgttgcactctagcctgggcgacagagcgagactgtctcaaaaaaaactaaacaaaacaaaaaaagttattagattaaaagcctcttaactatgtgtttatgaaaactccacgatgatgggatatatagagattacatttttcagtttttataaaacttaactagaagttgtgtaaattcatttgagaatagaggggaaggattcttgaaagcagttaatgtaagtaaatgagccagataaaaatgattttaaagttaccattggtgttatttttccctcattattgcctgagtaatctctggttttctggacattaaaataataatagctaata

SEQ ID NO: 60130 - DNA, 309 bp, Homo sapiens
ggagcagatgccaatccctgcccctctgctctctcttaggagcctggctggacttggacctggtgggtcggggcatcatctgtcaaatgctgctgcagaggctttgcccgcatctgcacctccgctgatgtcacctggccagagtgcaggagctgggctgataggctgtcaaggcaacagatgattctcagagactatgaaagatcaagccatgctgtgtatctactttatcactaatggccttttggaaacagtcatttcattttcagtcatactttctttaaatttaataaaactattgcaaggaaa

SEQ ID NO: 60131 - DNA, 332 bp, Homo sapiens
gtgaaatggatggaaattcaataaatacaagaggagcactttactctggctgaaagattacactctgaaacgatacagtgaaggtactgaaaaatgaacattttttataatagctttggtactgtaaaaaaaaaacctacagattaaaaaaatgaggagactgagactggttttctcaatgaagaactgctattacaaatatgaacctcaagttcaagataaaagtgtgtagggttggtgggccttaaatttctcctttctgtaaggaattggctgtagcagggcaatttgttccttgtataacactgcagacataaggcgaatgcttctcc

SEQ ID NO: 60132 - DNA, 495 bp, Homo sapiens
ccgctgcagtgccgagcttccagggacgtgaagccggaaagccaggcgcccttcttgactgcgcctaggtggaactggccctccagcagcttgaacgtagcctcttttcacactggtagttcctgaacctcttgtgaaatgaaagatgttcctcattccaagctgaggacggagaaaagccgtaaagctgacactggtcttaagaccctcatttgagagatgccttccctgtacctggaggaaagaaacatctttatctctgaagacacagggccacagagaagagtctgaacaaacaggctttaccaatttcccccagttgttaccgttagatcagacctttgtccagtcatatccttccacaagttgtccactcatcaaccctaagcataaaaatgcacaagtttccttgtttgtttgggtcttcatttccaagggctcctatgtcatgttaaacttttaaataaatttgcatgcttttctcttgtgaaaaaa

SEQ ID NO: 60133 - DNA, 486 bp, Homo sapiens
cccgcgggttgtggtcggagcgctggcgggggcgggatcgtgacgttaagggcggtgcccagtcagcgaggagctagaatgacttgtcagccacctttgagcaagaacttgcctggagtccaaatgtatggctattgaaggatagtaagcagacagcactaaaagtcatccattcgttatggatttagtcttaagaccctcatttgagagatgccttccctgtacctggaggaaagaaacatctttatctctgaagacacagggccacagagaagagtctgaacaaacaggctttaccaatttcccccagttgttaccgttagatcagacctttgtccagtcatatccttccacaagttgtccactcatcaaccctaagcataaaaatgcacaagtttccttgtttgtttgggtcttcatttccaagggctcctatgtcatgttaaacttttaaataaatttgcatgcttttctcttgtgaaaaaa

SEQ ID NO: 60134 - DNA, 369 bp, Homo sapiens
cccgcgggttgtggtcggagcgctggcgggggcgggatcgtgacgttaagggcggtgcccagtcagcgaggtcttaagaccctcatttgagagatgccttccctgtacctggaggaaagaaacatctttatctctgaagacacagggccacagagaagagtctgaacaaacaggctttaccaatttcccccagttgttaccgttagatcagacctttgtccagtcatatccttccacaagttgtccactcatcaaccctaagcataaaaatgcacaagtttccttgtttgtttgggtcttcatttccaagggctcctatgtcatgttaaacttttaaataaatttgcatgcttttctcttgtgaaaaaa

SEQ ID NO: 60135 - DNA, 534 bp, Homo sapiens
ggactgtgagttaaactggcatcaggcttcggaaggcctcactgattacagcttttacagggtttgggggaacaatacggagaccttggtgtccaaggggaaagaggccaccctgaccaagcccatggtgggtccagaggatgcaggcagctaccgctgcgagctgggctctgtgaattccagcccagccacgatcatcaattttcacgtcacagtgttgcccaaaatgatcaaggaggaaaaaccttctccaaatatcgtaaccccgggggaggcgaccacggagtcgtccataagcctccagcctctgcagcccgagaaaatgctggcaagccgccttctggggctgctgatctgcggctccctagcactgataaccggccttacctttgcgatatttcgtcgaaggaaggtgatcgatttcatcaaatcctcactgtttggccttggcagtggagttgccgagcaaacccaggtcccaaaagaaaaggccacagattcgaggcaacaataaagatttatcttgttgtctaa

SEQ ID NO: 60136 - DNA, 288 bp, Homo sapiens
gaagatggaaatagaccaccatacaaaacaaaaaagacagaagagaatattagcactctgttgcaaaggagaataggtatgctcaactggtaagtagaatgcaaatattccaatatctgaaaaaaatcccaaatccaaaatacttctggttccatgcatttttgctaagggatactcaacaggtattttaaaagatcaaaatacagatcagagaatatggatactgaagattatgagcaaacgagaataagaaaacatgttggaggacttttaaaaatgtgtaaagga

SEQ ID NO: 60137 - DNA, 434 bp, Homo sapiens
aacttgagagctaatgggaacgtttatatcaacgtttagcaggagataatcctatcttctctttcaaactttagttttgtgccataaaaattgtattttttcctgagattaatttggccttatttcttagttcaagtagttttattattactacgtcgtagagtttatctgtggattagccatccgtatcttggattgacacattcaaaggagaagaactgcaaagctttcattaaaactcagtgtgtttcttgatagtatttctcacctgagagaccttgtgcaaagaaaactctctggtgttaaacattcttattacagatattttctctatatccttgacctgtgaatgtttaccttttaaaaaatatatgtatttattttatattgcattccagcctgggcaacagcagcaaaactcggtctccaaaaaa

SEQ ID NO: 60138 - DNA, 620 bp, Homo sapiens
agaatatagtgtattgttattaacaaggagtgcaaggagaaagactgggacacttggagcattccttgtttccatagccttattctgcatcttcaaaacatgttacttattagcacctattttttggtgcctatgggtgtccgccaaaatggaaaaaggcaagaattgattttttattggcacatgtgatccctcacatccatctatccctgttgccctcaatgcctgccatcacatgaactctggatggttcacacagctttgacttttaaagattacttcttcaacactgttgggagttactgtgcctaaaaattagagcttgtagaatgaattaaaatgcttattcagcttttttactgaagaccacctaaagacagagggtagttctgagctttctcagaaaaagtcagtctgtaaagagtaaaataagtaaatatttcttctaatgtccagacattgctgtataaccacagggataaacaaaaatcagagaatcatggcattattaagtgaaaaaaaaaggtgctagtgactatctccaaacaaatggagatgtaagaactgcccaacaaataattcaaaatctctattttaaagaaggtcagcacactgcaaaa

SEQ ID NO: 60139 - DNA, 499 bp, Homo sapiens
atttttagctgaattcatctctttggctggattttgtgaatcgggcagccattagaaccaaaacagttctgaggagctcccaggctgcaatgtggtgcgaaatgttttatggacagaaaatggaaatgaggtgcagaaattggaggctaagaataaacttgaagacaaagagtagattttggccagacactgatgctaaagtcaccccgatgctgtctttgcttctaagatgaaatttcagtctttattcaagatcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattaggaacctttga

SEQ ID NO: 60140 - DNA, 242 bp, Homo sapiens
ttaaaacattctgatctagatatggacagaaaatggaaatgaggtgcagaaattggaggctaagaataaacttgaagacaaagagtagattttggccagacactgatgctaaagtcaccccgatgctgtctttgcttctaaggtataaattaccttattttaagcaactttttcaccttttcaactctatccctttcctcagcctctttcatatgtgaaataaaatattcacttactactga

SEQ ID NO: 60141 - DNA, 266 bp, Homo sapiens
aattgaaaaggcaataaggatttctacttctagtaatgacaggctaagctatttgaatcaactttccattcaaaagaactaaacatgctgaataagatattttttaaaaaatccttaaaagaacctaagaactgagatgatatcaaggaactagtaggataaaatctaagagaaggaatttctacttccagctttgatgagataacaggaatagaatttaccctccagccttaaacaactaaaaattgaataaaatatatgaaaat

SEQ ID NO: 60142 - DNA, 419 bp, Homo sapiens
gctacaatcataaagtttgtaagtgatctgctttatagaaatttaaatagagggtatccagggttagatgtggcataacatcatctcatcagcctctgacagacgtttgcccaggagagaacatggtggtgggaatcgatcagcaccttgggcaccatgggagtatggcccaagctggaacagaaccaggaatgcatgtggggggtggggtggggtaaagcatcaaggctcatgacttctgagcagagtctacaaacaggtcacatagaggcaggaagatccttagccatggagtcaggagacctgagtctgcccatgcccatgtgtgacttggataaatcccttgccaaccctggacttccagctcccacctgaatggtgaggggagggaggatgagctctctaagggcctcctgctc

SEQ ID NO: 60143 - DNA, 325 bp, Homo sapiens
ctgcaggggtccagccaggagatgggggcaacttggacagggacgatcctgggaagggcaggaggaggagtgagacctggcctgccctctccctagaggctcatcagctccctggagacagacacgccctggttcctttccctatgcctggagcctgggtaccagctattgaaaactgcttttctccttgttcattcaaacatattcacacataaaggttgtcattcctttttgtcactatttgacaaaaattggatcataccgtatacaattctctgctatttgttttgctcacctaacaataaatacactgtgaaaaatacct

SEQ ID NO: 60144 - DNA, 110 bp, Homo sapiens
atattattcagtcatgaaaaggaacgaaatactgatacatactacaatgtggatgaaccttgaaaaaaattatgtaagtgaaagaaaccagacgtaatagtctatattgt

SEQ ID NO: 60145 - DNA, 355 bp, Homo sapiens
gactctggctccaaaggagctccaggtactcttgcaaatggaaaggaaaccaacgggcctgcaacgtattaagctaggagagtggttggcagtgatggtggagaggtgggcagggtcccaatcgtggaggccccatggccatggaggggtctagatttcattccaagtccagtggggagcccctgaaggcttacggcaagggggtggggtgccatctgttccctgtggctgccatggaggaagtgggcacaaggaagggagagacaagtggaaaggctgcagtggaagctccaggtgacgcaggggtgaccagcgccactgctgcggcaggggggatggagaatcaggggctgac

SEQ ID NO: 60146 - DNA, 1031 bp, Homo sapiens
tcagatctgatgctaacggatggctaatgatggaggagcaacttcacttattttatgtacagaaaggaagatggttggtatctgtgcattaaaaatccaccaggataatctgaaagaaagatgggattcagcgtcttctgattattgaactgaccaagagttgactcaagctaccatgtgactcatgagttataaatttttttactattttattttttttcaggtatcctaagagaactgccaccattgaattgcatgggtagggggctgatttgcagctgagcaattttttcactgtggatgtaaattatggtgacacctgccaagacaaatacctggatataatgggaaaaagaatgctgctatacttgcccaatatttcagagcttgatttgcttcttcaaatatacaggctgcgaatgtggagaaatatttataagaaaagtttttacacagcttgcatgaccccaaaggagtgatacagaggccacataacactaatgattatcttttgaagctctccagggtcacctcatggcacaatcagactgagctgtacttaaggatcgaatatccctgattgactgttacatggcatacacaaaattttatgtgcacatggcatattcaaattgtcctgaaaccaaggatatataatgtcaacagtacatggctggtcccattgtgctaaaattttaaagctagtctcaggtgaccatgtccagaaaaaattacatccctggagactagtcattataattaaagataacttattaatcaaatagggacactccatagcagggaggtaattttttattatgcaaacaaatatttatcacatatttactatgtacttggcgttgcagaagatgttggggtggcaaagccattgttacagaagctgtgatgtccctcccacatcctcaggccaaccaccaagctcgtgacattcattggatctttccaggatattggctactgctggaagtcagcttggtatggtaataaaaaaatttaaaaggattggatgt

SEQ ID NO: 60147 - DNA, 3139 bp, Homo sapiens
cttggcacgaggactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaagagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccagagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatccccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtctaca

SEQ ID NO: 60148 - DNA, 471 bp, Homo sapiens
gtggtcacagcaggcctccgagagagcccagcaactctcatctcctccctcctttctcctgcctccctcctttttttcttccttgcattctctcatgtaccagaattgggcagaacaggttgggttatgctgcagtaaccaaaagtccctggctgcagttgcttaacagagtaaagatttggccaggtgcggtggctcacacttaaaatcccagcactttgcgaggttgaggtggaagtatcactggaggccacgagtttgagaccagcccgggcaacacagtgtgagacccttgtctctacaaaaagttaagaaattagctgggtgtggtggtgcacctgtaatctcataatcccagttacttgggaggctgaggcaggaggataacttaagcatgggaggtcgaggcttctgaactgagctatggtcgtacctctgcacttcagcctcggcgacacaaaacctgtctca

SEQ ID NO: 60149 - DNA, 321 bp, Homo sapiens
tggggtcttcatagggcagatctccaccatgtcatgcagagatgcagtgctgtcttctgatcaggaattatgctcttccacggcactctggctcattccacagtcaataatgttaaatggagtgaaaatgtaggtcagtggagctaacttggaagtctccaggacaactcttcctccaaatccattggaaaacatgaagcaacaggcagaaatgccaaggatttgactgctaaataccagataagtaagctgctcccccaaaaagtcttcagcatactaagcaagtcgtttactggaagaaatttaaaccttttttaaagc

SEQ ID NO: 60150 - DNA, 347 bp, Homo sapiens
tctaatttccaaccttctgatgcatttccacgatagctaaatctcttgcatcactaatggacaaataataccgctggcctgcgctggggttttggaaagaggttttcctagaatttgatgtgaattcagctactctcttgaaggatatgtttgcttggtacaggaaagatttcccttggcccagccagaaaagtcctgtctgatgagattcagcctaacttccctgcaggaggatgtgctctgtttctttctggggcaactgggatgccagctccctggcagaagttcagagttcagaggccccaaagcccctaactgaattaagtaaagaacctgggctagtgcag

SEQ ID NO: 60151 - DNA, 349 bp, Homo sapiens
catagcccccagtcatcttgacctttaaagttagatactgtgaacatttatggcaaaatgttgatggtgattgaaactgggtgaagggtgctgtagatctgttgtatgtctctacttttgtgcagagaattctgtggaaatgctcacaatacactttgaaaatagaagaaagatccctttaaagtttgagttattcctaaagattttcagcttggtacatgctgccatgcctttcctagatttcctgtggtagatgatttggaagtgttttattttaatcaggtagtgtattttgactcatgagttttaattttagcatatcaaaagtatttttagaagttttaaaata

SEQ ID NO: 60152 - DNA, 885 bp, Homo sapiens
tgaaatgaattgaggtaaaataaccgtttcaggtccatcccttacatggcaaagtaaaaagctggagtcagtacacagtgttggggtgggggcagcgtttgggggcgacgagttttgtgcaccgcgctggagtaccctgcacataaggtccgctcatgggcttctcagtacggactcgccggcgggaacaattaattgagcaaagcgcccctttctgggctggagcaaggttcgcggctgcagatatctcaagctgaaggcaagagcccaggcgaggcgcaggcaggccacgtggctgttccctgctgagactcgcagctttggtcttggaaacctcagggtgtggagctgcttgggccgactgaagggttcagctttttgggagaagtgagggcgagtgttatttctccagcgaggtgtaaacaagactgtgctttcatgggagggacaaattgcagagttgatcccttaccatttttacagaaatactcagaaagtgactacagcttgtcaactggcctgtttagtgagccgctgccttactgtaaaattgtctgaaaatcagattcgacttgacctccacttaatttcagtagcactctagcagttctcaaaacagtcacccctgcacccttgcgtttgcatcttccgctacaggattttatctcttggaagcgcttagagaatgcggcagaaattctgccccactctccaccaagtgttctttttgtaaatctgaatttacagtattctgcaattcttatttagaacgtggctgcagaaatctcgaaaccttttccacttcagctatttttttaaagataaatcttatttttgttttgttctttttttctcttttctcaaaaataaataaagagatcgaat

SEQ ID NO: 60153 - DNA, 415 bp, Homo sapiens
gatagatagatagatagacaccatggaatactactcagtcataatggcatttgcagcaacctagatggaattggagaccattattctaagtgaagtaactcaggaatggaaaaccaaagatcatatgttctcgttcataagtgggagctaagctatgagaatgcaaaagcataggaatgatacaatggactttggtgactcaggggaaagtgtgggagtggggtgagggatcaaagacggcacattgggtagagtggacactgctcgggtgatgggtgcaccaaaatctcagaaatcaccactaaagaacttatccatgtaaccaaacaccacctgctcaccaatagttattgaaataaaataaataaaccatacctgattgagggcacctgctttaaatcatcttcccaaacat

SEQ ID NO: 60154 - DNA, 351 bp, Homo sapiens
tccatttcatttcccctggaaacattttatattagatttgacaacttggttataatagagcataaagtacatcttaagtaggagatcatggccattatataaaaaataaattataaaatgcagtaccgattaaagggagaaacagcaaataaataaaagcataactaatgtacttttagtgttagctaggaatcattcatacacacactactacattgcttatctaaactgtattacattaatacaggcattgtgctaattacaggaatcatatcattacaaccttataatagagatgctaaatattattacaattttacagacaggaaactggggcataataaattaagt

SEQ ID NO: 60155 - DNA, 372 bp, Homo sapiens
cccatccctgtttaggtgctttgtcctccttgaggagcctccaatgctgctgctcctatacatgtcacaatttcagacccagcatgctaggaactgctgccagcgcctggttaagccaatactaaatggggccaaacaggtgaacagacattctgtctttctccaaacctctgaaaaagattctgcaactcatctcacagtaatttgttccctaatttactcttaggaaattgtcgttaaagtctgattaggttaagtccaattccctgtaattagatcctcagtgaagaaaaatctacccatcaccacaatttattttcttttctatagctccagcatcagtattgtaccattattttggcagctctggag

SEQ ID NO: 60156 - DNA, 415 bp, Homo sapiens
cctcccaggctcaagtaatcagcctctcgggtagctgagactatagtcacgttccaccatgcttggctaatttttttttatttattttttgtagaggtgggttctccctatgttgcccagggtagtctccaactctgggctcaagtgatcctccttaaaaaagtgttctttttttttgttttttgatttcaagatgcattttaattatttacataaattaattggttatctattttcttgaagtgtatttcaaagtcctacaaaacttaattgttgacctccttaaaatgtagttgagtatacttaaatttcctttgccaatctgaagtaaaactttaaattcaaaccctcaaagcaggtctttgcccttcctctaggaggttgggtcacggaattctgttttacgtcccttcat

SEQ ID NO: 60157 - DNA, 395 bp, Homo sapiens
gagagtctcagggctggcaacattcaccacaaactgactgaaggacccttgggccttgaatgaacatcagtgctagtacttgctgtgggcctagggccatgggggccatgggaacagactcctctgcttgcagaaaggggaaggaagagtgggaaggaatttggcttgcagcttggatgccagctcagctgaagtagaatagagcgctagatggattcctaaggtttccaactccaggccctagatcccaaatggcatctctgaatctgggaccaggagaaacttgctgctttgaaaggaaaaacacaagcctagctggattcactagctgctgactgtagagccttgagtgaacacacgcagtagccagacagtagttaacatgggccttgagc

SEQ ID NO: 60158 - DNA, 315 bp, Homo sapiens
gtctcttcatgcccaagagcacatcagagaaatggagagtgctcctgaatccgaaagggtcacacagacaagagtgaagaatgtctcaataaataccagtgtggaagaatgatcttgaggaccacatccttcactctctctccttcccccctccctttctgcacatcttgcatctcagaagccccctcccggaaactagatacaactccaggggaaggtgaggttgaaatccacaagttcactgagataaagtttctgacaatgcaaagaaagggaggcttgaaatcaaaattagtttctatttcttacataaat

SEQ ID NO: 60159 - DNA, 1871 bp, Homo sapiens
ccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtgagccggggcagctgtggacatgccccttgcacacgtgtgtccgcgggctggttgcaggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgcttcctgccctttgctggggtctccgaggccctggccggccggtgcccccctccccagctccaggaggcagctgagggggatgggggggcagatcttggactcatgaggaggggcccccctgcccagaggggtcaacccttctggaaactgtgaagatctgacttcgcccccccccccccccatcttcgggaccaggatttgcacagaagcacatgcacctacccatacaccccctcttctgagcgtccctgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccat

SEQ ID NO: 60160 - DNA, 1228 bp, Homo sapiens
ccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtgagccggggcagctgtggacatgccccttgcacacgtgtgtccgcgggctggttgcaggcgagtgtgccagagcgcagaggagtgagggtgtctgtgccgttgcgtggaggggagtgggtgagcctctgaaagcgcgggtgtgagttcca

SEQ ID NO: 60161 - DNA, 518 bp, Homo sapiens
cggccgctccccgctcatccacgccgtggaaaacaacagccttagcatggtgcagctgctgctgcaggtgcgtacagcccccctgagcctcgcgcccaccctatcctctgaccccaacccggctctggcctcagcccctagctctgaccccgccttccacttctggctccggctcctgctccgcgtccagctctgatcctttaaggcctagttttctcgaccctcgggctccacgcccctggctacgaacttgtcccattcctcctctgccacctcaacggcctaggccccgccctgcgatggcctggctgaccccgccttccagctaggccctgtccacgcattgtccttcccccctccagctcccccgactccttggggcgcgggcctcggtgtccagctccggttaattcatcgccgccaacgcagtcccgcttggcctgcccttggctctcgctcctaccttcctgtgaccccaccccgatccggtgccgccccacgtgccggccacccacccg

SEQ ID NO: 60162 - DNA, 1811 bp, Homo sapiens
ccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgcttcctgccctttgctggggtctccgaggccctggccggccggtgcccccctccccagctccaggaggcagctgagggggatgggggggcagatcttggactcatgaggaggggcccccctgcccagaggggtcaacccttctggaaactgtgaagatctgacttcgcccccccccccccccatcttcgggaccaggatttgcacagaagcacatgcacctacccatacaccccctcttctgagcgtccctgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccat

SEQ ID NO: 60163 - DNA, 495 bp, Homo sapiens
taaacaaatctcagattttcaaatcaaacttactgtataattttcagattattgttaaagcagttctgttgtccaaaaaaaatttggggtttaaggaagtatctccagaagtaaagagaatcactatatctgggaagaatctggctttatgttagagcttgctactttctggaatgttcagggagaaacaagaatttttgttcagtacaaaggaaagtacaagagagaccctcacagataatctctctgagacagtaacttcaaagagataacaatacattatcctgggagattcctggaactagggattagccctgctggcttctagccagggctgccatacatgagctcacccaggctccttggccatgagacagagttcttctaaatggtctctagaaggtcctttccagtactaggactataggaggagcatgtggcttttaataaagtgatgttgaaatgtgcctcatgattggcatgtgaaaagctaaa

SEQ ID NO: 60164 - DNA, 439 bp, Homo sapiens
gtgcattgttgagactgtaactcctttacttgaaccccactcacaggaggggttgcctctcatacatgaagccaggactcgtgtgaaactgtgaaactcatttctgtacattcccaagtgtgtgattgggaaatatacctttgcccagaacctgagtgatctgactgtttcctaggcccagcccacacataaaattgtgacatatacctgggccacccacctaagtaacgtgaaactccttcctgggccctgcctgccaagggcatttttacatttcactgtgaccagcatccacccaggtgctgtgactcccctgcctggtacctgcctacaaagagcattgtgacttatttctgggttcattatgtaggtgatgtgacttcattctactgccttggctctgtgcttagagtgcattgtgacatttagctgggtactg

SEQ ID NO: 60165 - DNA, 445 bp, Homo sapiens
tcacagttaatacactttgggtttcatattacactcccagtgcctttaagcacttatggtgagcataatacttattattttccacctcagttctagtgtcagagccagcacatatacaaacaaacaaacaaacgaaacctaactgtatgtatgtagtctaatggccgctcaaatatctgaaagggcagatatggatttgaagtctcacacataaggaaacatttattgagtgcttctggtggccaacattttacataggttatttcattttatcctcataagcaccctctgagatagttacagaaagagccagacttagtgaacaaatgaagttgagttttacagtgctattaactagctaaggtcatacaaatagtaactggagctaagatttgaaacccctgtccatctcattgcaagttcatattattttcattaatgatgc

SEQ ID NO: 60166 - DNA, 469 bp, Homo sapiens
ttggaaaagacctttcaatttattatggagctctggatcttcctttaggaaatgtgtaggaggagttggggtggttttagtctccatccttccctgtgggtttcacttttttccaacgaccctattttcataaagagggagctgctgcctaggatggattagaagtcatgctcatgaatagggaaagggctctcctcccttgtgcaccgttgtgaggctagtcctggagaagagtctgcctgagcctgtgacccagagcagttctcaaaggaaacagttccttggggcattgtttatggtcatgagagttggaggcaacctgggtatatccatccctgaggaaatggataaagtgtgatggaggcgcaccatgcagcaatgaactagaggtatgtacaggaacacagaccttagaaatgtaacatgaagcaaaaagtcaaaggaagatcctaagccgggttttacagcc

SEQ ID NO: 60167 - DNA, 427 bp, Homo sapiens
  misc_feature (37)..(37): n is a, c, g, or t
  misc_feature (41)..(41): n is a, c, g, or t
  misc_feature (57)..(58): n is a, c, g, or t
  misc_feature (65)..(65): n is a, c, g, or t
  misc_feature (71)..(71): n is a, c, g, or t
atggaaaaaaccatgcccttggaaaataggggccccnaaangatggataatccattnngccatgncatttnatccaatgataaataatggcccccctcatttattaaagccccccaatatggatcagatatagttccagagtccctttttttgtttttttttggttgttgttgttgttttgttttgttttgttttgttttttttgagactccgcctcaaaactaaactaaactaaactaacaagaaggatcttggcaacaagaaaaacaaggacagttcagaattcgagttgtcttaagaaatagaaaagctggccgagtgtagtagctcacacctgtaaccctaacctttgggaggccaaggtggatggatcacctgagctcagaagttcgataccagcctaggcaacatggcaaaaccccgtctt

SEQ ID NO: 60168 - DNA, 360 bp, Homo sapiens
gaagtgatttccaatttagaaaataggatttaaaaaaattatatttagtgagttataaccagaattacataagacagatatggaaattttataaacaaaatgcaaaatattctaatgtttcaatgttctacatgaacatatagggaagcatagacaatagccaaaaatatgttctgcattcatatactagttcaagtccgagtctggctactttctaggtagtgtgctttttgtcaaattataaagatatattccatttgttttttgaaaacgagtgagatgcttaaatagagtacaattatctcattcaaaatgtatgttgtttcctctcgagaattgtgaaggttctgagatttgatt

SEQ ID NO: 60169 - DNA, 531 bp, Homo sapiens
attaaaatcttgtcttatgaccctgacttttacactcaccatagtacatttaagccaatgaaactttaaagaagatggctcatttgcagacataaattggttctactgcctgcaactatttaggttttatgtccagtatggtaatttcaaggacagcaactgagaaaaatggaaagcatatctcttcatccagaagataaaaagaacagaccattaaaaaagaaaggtgaagagtcttttattgttaagctgtagatttttaacccaaactttatgtgagccccctgggaaaatgtgaaataccacattcttcatgtgtatagatactgtcgattgtcctcgttttataacattattgtctctctgacaggtgttatttgattcagatcagatcttgttaaaatgtatttcagagataatggtaagaaaatttttaaggaactttaggaaatattcaatccttgagatgataagccttagaagtgaacaaacagcaaacaaataaataaaaacatattttgtaactggatt

SEQ ID NO: 60170 - DNA, 298 bp, Homo sapiens
atttctaaaatgctctcaaatactaatattatacattctcccatttatcctcaaaaaacccatgagactggtgatgtaattactgtgttcatttcacagctgtggcagtcagtctaaagaccaagtgatttgctcaaagtcatggaacacttaaatggcagagctaaggcttaaacccagaatttaaaaattttttttagcttcttgttttttccattataccagtttggcccttcattttattcatgggttaaattaaattatggtaacaaagggcccctggtcactttggacattt

SEQ ID NO: 60171 - DNA, 189 bp, Homo sapiens
ctctcatacaaccctatacaataagcaccatactcatcaccactccacaggcaagggacataagctcagaaaggttaaatgatctgcccactttctaaatctcacaactagcaagccctgggggcagaatttacacccatttctgtctgagttcaaagttcacgcccaaaattgctataccatacagat

SEQ ID NO: 60172 - DNA, 233 bp, Homo sapiens
ttcccatcaacattttctcctggattatttttggcatatagaaaggaaattgttttttcatgttgatcttttttgcctctattctattatttttacctctcatttttgagtcatattttatcagttactacttctaaaactggaccaaatagtagtattgatgacaagtatttttgtctttttcttgtcattatgggaatgcttctggtgtttccctcttgaattctggatcc

SEQ ID NO: 60173 - DNA, 288 bp, Homo sapiens
gaaggagggagggaggtaagggaggaagggagggaaggaggaagaaggaaggaaggaaggaaggaaggagaaagaaagagaaagaagagaaagaaaaaaggagaaaaatgaaagattaacaaaacaagcaagtgaccaaagcaagcagggcagccagacctgatcaaattaactcctcagttttggtgacagtgactattcactgcttcccaatctccagccctcccttccttcttagtagcagaatcctagaaatgtgtctagctagaaaactattgtattagttag

SEQ ID NO: 60174 - DNA, 194 bp, Homo sapiens
ggaaggaacaattgataagaaccggggacatcagggagagagagtatttgagctgggcttgattccatcgggtagtatctggaaaaaaaaaaaaaatcccagatgaaagaatgtacaaagacatgagcatgcagggcacactttggaaaatgggagaagtctgacaggcctgggagaatgaagacaagttagca

SEQ ID NO: 60175 - DNA, 1168 bp, Homo sapiens
agcgggcgtcgtaagagaatgccaagcccggggagaaggcgttccgggcctcaactttggcgtcgtgagattcttgtgaggcgtctgcctggaagccggcagcaattttgcttctttaaagagaaaaagaaggctagggactcagattcctggattctgagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtgatttgtgtatgtttcaaca

SEQ ID NO: 60176 - DNA, 1253 bp, Homo sapiens
ataaagtacaaagttatttatggtcttcacacaaacaatccatacatgtggacaataattccacagcatcttccttccttcagaagcagaagtggaatcaatacaatgttataggatttactgcaaatcctgatttctactttggcgtcgtgagattcttgtgaggcgtctgcctggaagccggcagcaattttgcttctttaaagagaaaaagaaggctagggactcagattcctggattctgagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtgatttgtgtatgtttcaaca

SEQ ID NO: 60177 - DNA, 1082 bp, Homo sapiens
agcgggcgtcgtaagagaatgccaagcccggggagaaggcgttccgggcctcaactttggcgtcgtgagattcttatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtgatttgtgtatgtttcaaca

SEQ ID NO: 60178 - DNA, 1260 bp, Homo sapiens
cgcgatctcggctcaccgcaagccccgcctcccggattcacgccattctcctgcctcagcctcctgagtagctgggactacaggcacctgctaccacacccggctaatttttttatatttttagtagagatggggtttcaccgtgttagccaggatggtcttgatctcctgacctcgtgatctgccctcctcggcctcccaaagtgctgggattacaggcgtgagcaaccgcgcccagccgagattgccccgtttttttcccactgtccaggaatcgatttaatttttacagttgtttactttctcacatttttactaagtccagaatatcatcaaactcacaaaaccactggtcaaaaaaacccaaatggccactaattaggcaatacagcacctgcctcaaatttgggttcatatagatttttttcctccctttttgtggagaacatagtcttgctgtgttgcccaggctagtcttgaactcctggactcaagcaatcctcccgcctctgcctccctaaattctgggattacaggcgtgagctgctgtgcccagctcatccagattcttgctggttctctttctcagcctaaatgtcttgtttgcgtggagaaattatcaaatgaagcaggagtgccaaacaagcctcataggctcttcaccctacaacatctatgttaggtagaaaagtatgtggatttttaaaaatcatctggtataaagagtttttaagaactatcttcatcatcttagtatcagattgtgcttgagaagttaggtacaatgtaatgtgattcattgctaaaaacaaaatgcctcccacaattgcagactcactcattttaccaaactatggaatttgtcaacaccttttcttgggaccaaggaagcaaagtcagtggataccgtgtcctgtagacatgtcacttgtgataaggcacggacaacatgaactggcaaaaacattggcatttggtcaaatgcttatgagctaaggatagaagggaaaaaatagttgtgtgaatgattttacctcttagttcttacgaaggatggttatcgggctggaaaaatgtttattggactgatgctttggagcctctcaatgaatgtaataaaaaaaatgtgtagtgagcacaaatgtatggatttgcagcacaatccaactttgaaaatgtgaaaataagtgagttagtgatatgtttggttggtgttaatttgagtcctaaataaaatcgagaactggtaaaagaaggtca

SEQ ID NO: 60179 - DNA, 746 bp, Homo sapiens
ggtaatcccagaatttagggaggcgtgagctgctgtgcccagctcatccagattcttgctggttctctttctcagcctaaatgtcttgtttgcgtggagaaattatcaaatgaagcaggagtgccaaacaagcctcataggctcttcaccctacaacatctatgttaggtagaaaagtatgtggatttttaaaaatcatctggtataaagagtttttaagaactatcttcatcatcttagtatcagattgtgcttgagaagttaggtacaatgtaatgtgattcattgctaaaaacaaaatgcctcccacaattgcagactcactcattttaccaaactatggaatttgtcaacaccttttcttgggaccaaggaagcaaagtcagtggataccgtgtcctgtagacatgtcacttgtgataaggcacggacaacatgaactggcaaaaacattggcatttggtcaaatgcttatgagctaaggatagaagggaaaaaatagttgtgtgaatgattttacctcttagttcttacgaaggatggttatcgggctggaaaaatgtttattggactgatgctttggagcctctcaatgaatgtaataaaaaaaatgtgtagtgagcacaaatgtatggatttgcagcacaatccaactttgaaaatgtgaaaataagtgagttagtgatatgtttggttggtgttaatttgagtcctaaataaaatcgagaactggtaaaagaaggtca

SEQ ID NO: 60180 - DNA, 344 bp, Homo sapiens
ctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcactccagcctgggtgacagagcaaaaaaactccgtct

SEQ ID NO: 60181 - DNA, 2001 bp, Homo sapiens
aatcccacctacttgggaggttgaggcaggagaatcacttgaacccgggagtcagaggttgcagtgagccgggatcgtgccactgcactccagcctgggcaacagagcaagactctgcctcacaaaaaaattaataataataatgataataggccgggtgtggtggctcacacctgtaatcctagcattctgggaggacaaggcaagaggatcacttgagctcaggggcatgagctgtcacacccagtcaacatttttatcagtaattacaggtatggacttacagctccaaaaaattaaaaagaatgcagagaacagaaaataatagagctaaattttttttttaatttacaagccacgtatggtggctcacacctgtaatcccagcactttgggagggtgaggtggaagggccatttgaagcgaggagtttgagattagcctgggcagggagaccctgtctctacaaaaaaatttaaaaattagtgggctgtggcggcacgtgcctatagtcccagctacttaggaaactgaggtgggaggattggttgaggcttcaatgagccataattgcaccactgcactgcagcctgggcaacactctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctgttgtttattgttacttttctccttttttaaaaaaaaaaaaaggcagccgggcgcagtggctcacgcctgtagtcccagcactttgggaggccgaggcgggcggatcacaaggtcaagagatcgagaccatcctggccaaca

SEQ ID NO: 60182 - DNA, 955 bp, Homo sapiens
agaggaccaccctccataatgtgtgccatgtcctcctgacactctgagaactcaacatttcttttgaggcactcatgccagaatgcacaacctatatttaatcatgaaaaaccaccaaactccaactaatgaacataaaataagccataaaaggcccgtacttatttttgaagaaaacaaagacagtagtacagttaacaaaggaagttaacatatagtgctcttatgaatctgtagactttgttgaaaatccatcaattgttccagtaatactctttatagtgaaagacaagtgttttcctgatcccagatgtcacactgttaacacgtttagcaacctataatcaggaatatttcctcagtctgtttcatggctttgtactcttcaaaaataagtacgggccttttatggctgattttatgttcattagttggagtttggtggtttttcatgattaaatataggttgtgcattttggcatgagtgcctcaaaagaaatgttgagttctcagagtgtcaggagggacatggtatcatttcattccgttaatggtgatactgccttgattccttggttaaggtggtatgagcgaggtttctacaatatactttttttcctctgtcatcaataagtatcatgtggggagaaaattaaaaagctcgttactgcctggcactgtggctcacgcctgtaatcccagcactttgggaggctgagacaggcggatcacctgaggtggagagttcgagaccagcctgaccaacatggtgaaacgctgtctctactaaaaatacaaaaattagctgaccgtggtggcacactcctgtaatcccagctacccaggaggctgaggcaggagaatcacttgaaccaggaaggcagaggttgcagtgagccgagattgcaccattgcactccagcctggcaacagaatgcaatgtctcaaaaaaaaa

SEQ ID NO: 60183 - DNA, 1530 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60184 - DNA, 2162 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctgttgtttattgttacttttctccttttttaaaaaaaaaaaaaggcagccgggcgcagtggctcacgcctgtagtcccagcactttgggaggccgaggcgggcggatcacaaggtcaagagatcgagaccatcctggccaaca

SEQ ID NO: 60185 - DNA, 2189 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgggtcatctattcaggttttgttttattttaatggtgatggtaaatggagttcccacatttacaattcagaacacagaacccaagcagatacgttaaagttagatgattatttctaaaatatcattttctttttcattatagaggtagtagtaggtgcttatgtagagaaagtagaaaagtacttaaaaagaaaatcaaggccgggtgcggtggcttactcctgtaatcacagcactttgagaggccaaggcgggcgcattacctgaggtcaggagtttgagaccagcctggccaacttggcgaaaccccctctctactaaaaatacaaaaattagctgggcgtggtgacatgtgcgcctatagtcccagctacttaggaaactgaggtgggaggattggttgaggcttcaatgagccataattgcaccactgcactgcagcctgggcaacactctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60186 - DNA, 1533 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggatccaaagtcatttcattagtgtttttaacttttaa

SEQ ID NO: 60187 - DNA, 1479 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttataatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60188 - DNA, 1622 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60189 - DNA, 1462 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60190 - DNA, 1194 bp, Homo sapiens
ccacgcgtcgcggacgcgtgggtcgacccacgcgtccgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60191 - DNA, 1143 bp, Homo sapiens
tacctacgttaggtcacaatacggacagattcctagccaggagactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60192 - DNA, 1502 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccagcgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60193 - DNA, 1815 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctgttgtttattgttacttttctccttttttaaaaaaaaaaaaaggcagccgggcgcagtggctcacgcctgtagtcccagcactttgggaggccgaggcgggcggatcacaaggtcaagagatcgagaccatcctggccaaca

SEQ ID NO: 60194 - DNA, 1501 bp, Homo sapiens
  misc_feature (1321)..(1321): n is a, c, g, or t
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacgtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaataaaaaaaaaaaaaaaaaaaaaaaaaaacaaaaaaaaaaaaaaaacaaaaanaaaaaaaaaaaaataacccgggggggggcccctttttttttaaaaaaaaaaaaaaccccccgggggtggggggttccccccccccccccccttgggaaaaaaaaaattttttaaatatcaggtcctttccccccccccccccccccggagggccccaaaaaaaaacccccccacccctag

SEQ ID NO: 60195 - DNA, 884 bp, Homo sapiens
ccacgcgtcgcggacgcgtgggtcgacccacgcgtccgctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60196 - DNA, 1932 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgggtcatctattcaggttttgttttattttaatggtgatggtaaatggagttcccacatttacaattcagaacacagaacccaagcagatacgttaaagttagatgattatttctaaaatatcattttctttttcattatagaggtagtagtaggtgcttatgtagagaaagtagaaaagtacttaaaaagaaaatcaaggccgggtgcggtggcttactcctgtaatcacagcactttgagaggccaaggcgggcgcattacctgaggtcaggagtttgagaccagcctggccaacttggcgaaaccccctctctactaaaaatacaaaaattagctgggcgtggtgacatgtgcctgtagtcccagctactcgggaggctgaggcaggagaatcgcttgaacccaggaggtggaggttgcagtgagccaagattgtaccaccacactccaggttgggtgacagaatgggattctgtttcccccaccaaaaaaataaatgaaaagaaaatcaaggccaggcgcggtggctcacctgtaatcccagcactttgggaggccgagtcgggcagatcacgaggtcaggagatcaagaccatcctggctaacacggtgaaaccccgtctctactaaaaattacaaaaaattagctgggcgtggtggcaggcacctgtagtcccagctgctcgagagggtgaggcaggagactggcatgaacctgggagtcggaggttacagtgagccgagattgtgccactgcactccagcctgggcaacagagcgagactctgtctcaaaaaagaaaaaaaatcaaaagctcattgcggccgggtgtggtggctcacgcctgcaatcgcagcattttgggaggccgaggcgggcagatcacctgaggtcaggagttctagaccagcctgactagcatagtgaaaccccgtctctgctgaaaatacaaaaattagccg

SEQ ID NO: 60197 - DNA, 799 bp, Homo sapiens
ggtgatttgagacacccccacttatgcaaacacgaccggcggaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60198 - DNA, 1369 bp, Homo sapiens
aatcccacctacttgggaggttgaggcaggagaatcacttgaacccgggagtcagaggttgcagtgagccgggatcgtgccactgcactccagcctgggcaacagagcaagactctgcctcacaaaaaaattaataataataatgataataggccgggtgtggtggctcacacctgtaatcctagcattctgggaggacaaggcaagaggatcacttgagctcaggggcatgagctgtcacacccagtcaacatttttatcagtaattacaggtatggacttacagctccaaaaaattaaaaagaatgcagagaacagaaaataatagagctaaattttttttttaatttacaagccacgtatggtggctcacacctgtaatcccagcactttgggagggtgaggtggaagggccatttgaagcgaggagtttgagattagcctgggcagggagaccctgtctctacaaaaaaatttaaaaattagtgggctgtggcggcacgtgcctatagtcccagctacttaggaaactgaggtgggaggattggttgaggcttcaatgagccataattgcaccactgcactgcagcctgggcaacactctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60199 - DNA, 1491 bp, Homo sapiens
ttcctttaattataaacatagtttttacaaattctttttgtgacctaaagaggatttcttttgttttcaacttcaaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgggtcatctattcaggttttgttttattttaatggtgatggtaaatggagttcccacatttacaattcagaacacagaacccaagcagatacgttaaagttagatgattatttctaaaatatcattttctttttcattatagaggtagtagtaggtgcttatgtagagaaagtagaaaagtacttaaaaagaaaatcaaggccgggtgcggtggcttactcctgtaatcacagcactttgagaggccaaggcgggcgcattacctgaggtcaggagtttgagaccagcctggccaacttggcgaaaccccctctctactaaaaatacaaaaattagctgggcgtggtgacatgtgcgcctatagtcccagctacttaggaaactgaggtgggaggattggttgaggcttcaatgagccataattgcaccactgcactgcagcctgggcaacactctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60200 - DNA, 812 bp, Homo sapiens
gagctagcaggttagcatgctcagccccctggccacgtgatgccttgcaccacctcaggactctgttgaaagtacccagcagcaaagaaggttctcaccagatgcagctccttgatcttggccttctcagcctccattaactgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60201 - DNA, 838 bp, Homo sapiens
  misc_feature (792)..(792): n is a, c, g, or t
  misc_feature (795)..(795): n is a, c, g, or t
  misc_feature (819)..(819): n is a, c, g, or t
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaatgnagncagttatcctcagcgaaagcgggncgcgaatttagtaatagta

SEQ ID NO: 60202 - DNA, 531 bp, Homo sapiens
atatgcggatcccccaaacgcagagaggatattatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60203 - DNA, 1907 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctgttgtttattgttacttttctccttttttaaaaaaaaaaaaaggcagccgggcgcagtggctcacgcctgtagtcccagcactttgggaggccgaggcgggcggatcacaaggtcaagagatcgagaccatcctggccaaca

SEQ ID NO: 60204 - DNA, 463 bp, Homo sapiens
agtcctgctgttttcctgggctcactgtttgaccacagagaagtggtctcaactctctgggtcttggtttgcctgtctttaaaatggggcagtaatcccagtaggtggtgactcccacggggcgtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60205 - DNA, 918 bp, Homo sapiens
  misc_feature (843)..(843): n is a, c, g, or t
  misc_feature (850)..(850): n is a, c, g, or t
  misc_feature (892)..(892): n is a, c, g, or t
  misc_feature (917)..(918): n is a, c, g, or t
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcacaagaattcatagtggttccagttgttccttcttgaaaagttaactngccttgnttggccctcctggcttggcccctttttggaaaccccagttgnttaccaagttccggcccaataattnn

SEQ ID NO: 60206 - DNA, 251 bp, Homo sapiens
gtaagaaataaattcctttctttataaattacccagtttcaagtattgtgttataagcaacagaaaacaaagacagtagtacagttaacaaaggaagttaacatatagtgctcttatgaatctgtagactttgttgaaaatccatcaattgttccagtaatactctttatagtgaaagacaagtgttttcctgatcccagatgtcacactgttaacacgtttagcaacctataatcaggaatatttcctca

SEQ ID NO: 60207 - DNA, 667 bp, Homo sapiens
taattggattaaagcctgaaggagtgccaaggatagattgtgtttcaaaggttagtattcaaaaagtaactcctgttaaatctttgatgtttcttaaaatactttaaaagtctaatgatttagtcatcttttttttcttccctgtcacattttaaagtcctttgtagtgccttagaataaaattccaccaaccgtagtctttctcttccttaatgataattcagaaagacattttccatgtgtatttgattttgcacacattgcctttattttcacatataccgtatttcatcaattctaagattcactttttttctgccagctcagtaacactgaaattgggattacccttgtaattgatggtgtcttaatactgtatcatgacatttttctctttcttaatagttagttggcgtgctagtcatcagtgctatctgagatttaatgaaatatggtgcattttccttaaggtagaagcattatttatctcccctatccctacttacttttttttccagaatactgtgcagttttcatctcataactttcttttgttttctctccatgctgcaaatgccactaagacaaataatgtaaaagatgggtaagagttctgaggagacattaagttctaaatttatcattgtgctaaatattaacatttcaa

SEQ ID NO: 60208 - DNA, 1522 bp, Homo sapiens
ctaggtaggggtcgggtgtgaatcggccgaggcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60209 - DNA, 1760 bp, Homo sapiens
  misc_feature (1580)..(1580): n is a, c, g, or t
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaataaaaaaaaaaaaaaaaaaaaaaaaaaacaaaaaaaaaaaaaaaacaaaaanaaaaaaaaaaaaataacccgggggggggcccctttttttttaaaaaaaaaaaaaaccccccgggggtggggggttccccccccccccccccttgggaaaaaaaaaattttttaaatatcaggtcctttccccccccccccccccccggagggccccaaaaaaaaacccccccacccctag

SEQ ID NO: 60210 - DNA, 1615 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagttagttggcgtgctagtcatcagtgctatctgagatttaatgaaatatggtgcattttccttaagacaaataatgtaaaagatggaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60211 - DNA, 1502 bp, Homo sapiens
ggtcacagagcccagagagcgtcctgtaggaacgtcacagagcccagagaacgcctggggacggtcggggaggcagttcggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaaggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60212 - DNA, 1355 bp, Homo sapiens
cttgaatttggacagtgaaaaggcccttaaaaggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60213 - DNA, 1321 bp, Homo sapiens
  misc_feature (1259)..(1259): n is a, c, g, or t
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccacaaggggnttctcagacacaagatataaaagatagccagtgggcttgattcgaacgatttacaaggttaa

SEQ ID NO: 60214 - DNA, 1138 bp, Homo sapiens
tacccctctataaggagagcccagagtcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60215 - DNA, 1239 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcaaagggcagcagaggcaacaggcagttacttcagaggacactgaacacta

SEQ ID NO: 60216 - DNA, 1343 bp, Homo sapiens
ctcaggactcggtatcgtacaacacttctcagtgtctcatatctagatggaggtcgctattacaaatgaagacgacacacaacatttactctgtggagatattctactcatactatgcacgtgctgtgattttgaacataactcgtcccaaaaacttgtcacgatcatcctgactttttaggttggctgatccatcaatcttgcactcaactgttactcctttcccagtgttgtcaggagcaaagctgacctgaacagcaaccaatggctgtagataccccacatgcagttttttcccataatatgggaaatattttaagtctatcattccattatgaggataaactgctacatttggtatatcttcattctttgaaacacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60217 - DNA, 1183 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60218 - DNA, 1655 bp, Homo sapiens
  misc_feature (965)..(965): n is a, c, g, or t
  misc_feature (1247)..(1247): n is a, c, g, or t
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaaccacatcgccggaaccacccacctaccaagcatangatgaacacagaccagcctcccgcgcccaccccctggccccacccgacccgagggtgcgctatgtcagaccccgcagtacctaacagaccagcacgcgcgaaaagaggcgaacggcccccacaacatcttttcctatgtccaccaggttactaacaaacaaacccagagagggagttcaatgtaaagtcactctactgcatcgttcgtaaactgccattcacgcacgccggcctgtccttcctgattccgccgcgcccaacactgcacaaacaaacaaacgnctgtataaagcaagtgtgtgctgccgcacgatgttcggcgtgttgtgaaacgacgcgaggtaccacgagatgatcttacattcacaaacacacccacccgtgcgccacccccgtcctcactgtagctccccccacccacaagccccaaccatccgaggccgcacgacacagagtccacagacccacgcccccacgcctccacactctctcggtctgctctccacccccacacacgtaggcctaccagtcgatgcgcacaccacataacgtccctgtaagtaacatctcacctagcacacgtccaaatctaaagactacacatgaaacatctaacaaccgccagcgtagcgcagagatgacccacaccattacgacgcctcgccctctgcttcacccgccctccccccg

SEQ ID NO: 60219 - DNA, 1294 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaacaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60220 - DNA, 1167 bp, Homo sapiens
  misc_feature (19)..(19): n is a, c, g, or t
ttaggcacgaggcgtaacnaggagtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaacgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaata

SEQ ID NO: 60221 - DNA, 1310 bp, Homo sapiens
agcggaagcggccgcccggcgcggcgcggcggagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagttagttggcgtgctagtcatcagtgctatctgagatttaatgaaatatggtgcattttccttaaggtagaagcattatttatctcccctatccctacttacttttttttccagaatactgtgcagttttcatctcataactttcttttgttttctctccatgctgcaaatgccactaagacaaataatgtaaaagatgggtaagagttctgaggagacattaagttctaaatttatcattgtgctaaatattaacatttcaactctgattgtatggcagaaatattttacttagaatgttacattgaaatcacttttaaagttgtgaaaaaaaattctttttactgttaatggacttcttatttgggcagaaacttcttgctcagtggtcttcaaacttgatcactcatcagagtcatgttgccttgttgggttccgttcccatagtttctgactcagtaggtctgagatagggtccaaaatttgcatttttttctttttttttcttttagacggagtctcactctgtcgcctgggc

SEQ ID NO: 60222 - DNA, 291 bp, Homo sapiens
gagtataagtgactttttatgactattttctgatttaaaatataggaaatacattttccttaattggaaaaccaaaatttactttttagagttagtagttacaaacatatttttgacagttggctattaaacatgtttttgtttttgtttttagagacaggatctcatcctgttgcctaggctggagtgcggtggcgtgctcatcgttcactacagcctcaaactcctgggctcaaatgatcttcccacttcagccttcctagtggctggaactacaggtgtgcaccaccc

SEQ ID NO: 60223 - DNA, 1837 bp, Homo sapiens
gctcgtccgcctcgcgcccgggggctccgcgcctggagctgcgccggcggcagccatggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaaggtaggcagcgctgcgccgccgaccgccctgtccccctggtttcgcctcttgaaaagtgtgtgcacgatcaggaaagggttttcttggggccttctttaaatgccgttgaccagttcagccccggattaccggctttgttttgagtcgatgtgttacgctgtcgcttgcttatgttttctttgtaaattaattctcctaggtattttgagagggagtggggtgagctggcagattgaagggtaatcagcgtttttggattcaacaagcatttgttgaagtattgaaggcttgtgggccagacagtgttctaatgccagctctagagcttccagtctggaatgatgtggggtagggaatgggatgttgaaggccaaggcctcagaggaaggaggtgatgcttgcgttgagatctgaatgatgagaaggatgcagtcagggcaagctgtaggactaatccaggcaggaggaacagcaagtacaattgccatagacccgaaggagctgagtgctggagacagggaaagaaaagcagtggcgttggagcttaggaggcagatgagtttcgccagatcacgtaagacctaggaggcaacggtaaagagtttggattttattctaagcccagtggaatctgacaacctacaggccaggtaccgtgctgagtgcccagcaaaggcagtgagcgtgctattttggagatagcatccttttgtttaaggcgcattcaatcccctacaatgtatgagcacgggcttgcattttattgtctgcaagatcacggtctacttactcgggttgctgccgggtcgtgaggctttgtaaattgtttgtatcacttcacccgggattaaaacggggtgtttgtttggggtcccagttggattaaagcgttcctgataattgatgcacatggcttgcttcctgcaaaaaaaaaaaaaaaaaaaagaaaaaaaagaaaaaaaaagaagaagaaacccgcagctctgggcagagaactgaagctccctacagactagtgattgttgttcttgggggagggggaaacctgtcagtgttcattccacaagcatcaccgctcttgagtttcagcccgagaaagcagtgtttgccatgtgacccatgagatgccaacccccaccttcctccctcctgcctccattagtgaagcactgttctgcagcagccagtgggtcaaatggttgtcactaaatgtctctttttggtgacatttgctttttaagaaagaggcagtatagtatagtggttaagagcaaggtc

SEQ ID NO: 60224 - DNA, 794 bp, Homo sapiens
gctcgtccgcctcgcgcccgggggctccgcgcctggagctgcgccggcggcagccatggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatata

SEQ ID NO: 60225 - DNA, 468 bp, Homo sapiens
aatattattttaaaacacaacattacaaaatgagttggtaatattgctagatggatcattaaacataaagacatactgttttgggccctccttgtttttactgataaactaaggcttagagatgctcatttaacgggaaagaacagttaacaaaccaaggaactgagaatggagccaaggtaatttgcttctaaaaccagtacattttttcactattccacactgatagcttctatttagatcataaaccagtgttttcaaaatataaacccagatccaccagtattccctggatgcttttcacaacttacctacaggcccacctcttgacattctgattctgtagttatgagaagagacactagcatctgtgttttaacaacaaaacacccaaaggatctgatgcacatggaactttgagaacactgctgaatacacagcccattcccacgctgctataaggacata

SEQ ID NO: 60226 - DNA, 1446 bp, Homo sapiens
aaccattgtgatggtctagataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttcaagcgtggctatccccaacttttagtaagagtgaagagaagaattggtgttaaaaatgcttcacctatatctactttattcaacgaagatttcaacaagaagcattttagagcaggggctaacatggagaatcataattctgccttagctgctgaagctagtgaagaaagtttattttcagcctctaaaaatttaaatatgcctctaacaagggaatcttctgtcagacagataattgcaaattcatctgtccccattagaagtggtttccctcctccttcaccttcaacctcagttggaccatcagaacaaattgcaacagatcaacatgctattttaaatcagttgaccactattcatatgcactctcatagtacctacatgcaagcaaggggccacattgtgaattttattacaaccacaacttctcaataccacatcatatctcccttacaaaatggttattttgggctgacagtggaaccatctgctgttcccacacgatatcctctggtatcagtcaatgaggctccatatcgtaacatgctaccagcaggcaacccgtggttgcaaatgcctacgatcgctgatagatcagctgcccctcattccaggctagctcttcaaccatcaccactggacaaatatcaccctaattacaactgatctgccattaaaagaggaccagattatgaatgacaacagagactaacatttacattgacaaaaaaccctaaaaatttctgcaattatcttattgaacaataaaattgcatgtttacttctaaa

SEQ ID NO: 60227 - DNA, 1020 bp, Homo sapiens
aaccattgtgatggtctagataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaaggtatttgacatatttgagttaccactttatgtaaagtatatatgtaattttactttgtacatcagtaaatatgttaatacatgcagtaagaccagcttttgaaaattatataaaatattaaggtagaaattttgttttgaaattattgtgttcagcttgagcgttaaccttttagtgttttaagaaattttgctaacaactttgaatcttaccagtgaattccaaataaatgtaccaaagccacttaatgaaatattactattaatatataacatgttttcacttgagggcttaacaacttgagtggtttttcacaataagcacattcttaaaaatagtaaacgatgtttatgagttatttgatgacattaaatttgtgtgatgaaagag

SEQ ID NO: 60228 - DNA, 598 bp, Homo sapiens
aatttcttgccttctcaaatgatagaggggcaaggcaatttttggtagattgagagcaaagaaaatgtgccattaatcgggatagatgcttccccaatagtggttaaatttacgaagaatggatttgagactcatggatttaaaaaggggaagagagaaatagctctattgtgttatttaaaaagggaaagagctctattgtgttatttctgatacagcaccattttgattttttaactttttttagcttgttatggaaagtttcaaatgtacacaaaagtataatgaatatgcctagcttaaaaacgatcacggccaggtgtggtggctcatgcctataatcccagcactttgggaggccgaggcggatggaacgaggttaggagatcgaaaccatcctggaaaaaggtgaaaccccgtctgtactaaaaattaaaaaaaaaaaattagttgggcgtggtggtggatgcacatagtcccagctactcgggagactgaggcaggagaatggcgtgaacctgggaggcagagcttgcagtgagccgagattgcgccactgcactccagcctgggcaacagagcgagactctgtctcaaa

SEQ ID NO: 60229 - DNA, 463 bp, Homo sapiens
ttctgcacttcctagtacatgagccaataaagctcttattttttaagttatttcagattgggtcactatcattcacaataaaagattcctcactaatacagttcacacctcactaattacatgcttctaaatattgcagcaatctgcacaaaggaaatctctttctactactagattatacatttcttgaaggcaggaaagacatgtctagcacaatgtcctgcacatagttcaatatgtgttcaataaatatttacaaaagaagcaaatgagcaaaagaagttattttgtcataaaatcaagacctaaaattaaacaacttgacaagtgaatgagaagatcacaatgaataatacacaagccataatatagctcattttattgcatttcactttattgcacttcacagatactgtggtttgtttttttgttttctttttaacaaattgaaggtttgtgacac

SEQ ID NO: 60230 - DNA, 416 bp, Homo sapiens
caaggtggttttagcttgtcagtaccagcgcagcccgaggtttgaggtggggcaagcaacgctgcaggaagatcctaggcactcaggtcagactggccaagtcaccccgcgccatgcctttgcgcaagttaaagggcggactgatttaacacaagtctttctgatacggtcactgcctccaaactagatttctgaaggtggtagaatcatgtagcgcttgagctgcagatatttaaaacctgagacttgcagggatctcttgtccttgatttctttttcatgtgggacacactagccaaagccagcatctgtcggagacactgccaacgaaggcagcgccacagccaatttgcagagaccgcttgtcctccctaagtgtagtccttgaacaaattctaccaggcaggaagccagcc

SEQ ID NO: 60231 - DNA, 892 bp, Homo sapiens
  misc_feature (697)..(697): n is a, c, g, or t
  misc_feature (701)..(701): n is a, c, g, or t
  misc_feature (716)..(716): n is a, c, g, or t
  misc_feature (749)..(749): n is a, c, g, or t
aggcctgggtagggtgagcggcctccgaagcggagcggggctctgaggagacactttttcttcctccctccttccctcctctcctcctgccttcccttcccctttcctcccctctctcctccttctcccctcggtcagccggagcctgctggggcgagcggttggtattgcaggcgcttactctccggggccgcccggcgagtagctggccggggaaggaggcaggaaccgcgatggcgcctcagaagcacggcggtgggggagggggcggctcggggcccagcgcggggtccgggggaggcggcttcgggggttcggcggcgacggcttcgagcggcaaatccggcggcgggggctgtggaggcggtggcagttactcggcctcctcctcctccgcggcgttaccggtgaagaagtcgaaaatggagcacgtccaggctgaccacgagcttttcctccaggcctttgagagaaaacatttaaagttgatgatatgttatcaaaagtagagaaaatgaaaggagagcaagaatctcatagaaaaagaggaatccagtcgggctcggtggctcacacctataatcccagctacttgggaggctgagacaggagaatcgcttgaactcgggaggtggaggttgcagtgagccgaagattgcgccattacactccaacctgggcgagaagagcgacactncccnatctcaaaaaagaanaagaggagtcctggtcaaatttacagggctaanctcttcataatatgtccttatttccagtcattacttgctccttagtactctcttgccacaatatctttctgtaactgttcccatctgactataaaaatgcctagattgtcaccatcatttaaaaatatatatatatgcccttt

SEQ ID NO: 60232 - DNA, 604 bp, Homo sapiens
ccaaaataattttttgccacccaggaaacctctttatctttaccaaatgtctcatcgaaactccagaacaaacatcaaaaggtacattttatgaatcttatttcaagctgatcaaaccatgttagttttattttaaagtactatttctcaaaattaaaaaaaagaacaaaaataagtactatttctaactaaagatttaatatgaaaactgaagtgagagagtgactggttgaattggttgcacagtggttttcaatagtataatctttgtaagtctcaggttgttattagctttttttttttttcccctaatagaaatgaggctgggtgtggtggctcatgcctgtaatcccagcactttgggaggccaagttgggcggatcacttgaaggcaggagtttgagaccagtttggccaacatggcaaaaccctatctctcctaaaacaaaaattagccgggcgtggtggtgtgtgcctgtaatcccagttacttgcgaggctgaggcaggagaattgcttgagcccgggaggtggaggttgcagtgagccgagattgcgccgttgcacttcagcctgggcaacagagcgagactctacctcaaag

SEQ ID NO: 60233 - DNA, 623 bp, Homo sapiens
  misc_feature (33)..(33): n is a, c, g, or t
tttagctctgataccaactgttcattaaaaacnaagtgtccaaagagcagaagagacaaggtagagccgagctcggctctaccatgtcagtgaagagcttccagccagaagaaaatgaaatcgtgaggatggggaaaagacatttgttgcacaaatgacagtatttgataaaaacaggtaatgttgatgaacaagcgaggctcccacaatgttctggaaatgttttcattctgaagcagaatataattatttatattgattatttcattgcctttgtttctttttattcttacggatgaaaaaacaaatttgcaaacactgaatttttgtctgtttcatagaaaacaataattaaggaactatttgcatagatagctcagttaaacttacttatttggcgaatattttgagtgtctgctcttttccagacactgttctggacattaaggcaacaaaatccctgccttcaccatggagcttaacttttagtggaggaaacagaccaccacccaaaaaatcaactgatgtcacttagtgatgagtgttgtgaagaaaaatagagaataaatggttactgttttagagcgatatcctctgggaggaggtagtactttgagaagaga

SEQ ID NO: 60234 - DNA, 3581 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60235 - DNA, 2414 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacaggtaatgttgatgaacaagcgaggctcccacaatgttctggaaatgttttcattctgaagcagaatataattatttatattgattatttcattgcctttgtttctttttattcttacggatgaaaaaacaaatttgcaaacactgaatttttgtctgtttcatagaaaacaataattaaggaactatttgcatagatagctcagttaaacttacttatttggcgaatattttgagtgtctgctcttttccagacactgttctggacattaaggcaacaaaatccctgccttcaccatggagcttaacttttagtggaggaaacagaccaccacccaaaaaatcaactgatgtcacttagtgatgagtgttgtgaagaaaaatagagaataaatggttactgttttagagcgatatcctctgggaggaggtagtactttgagaagaga

SEQ ID NO: 60236 - DNA, 2775 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60237 - DNA, 2848 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccgatgtcagtactttgtgtgctcttgaaataggaaatgtacagatccctattgccagacacatcattctctccatccagaaagccaactttgcaaggacatagatctagaaacatcaaatagcatttcgtgtggtgggaaccaaagttggtgggtctttttcccacactgagccgtgtgtcgatttattgaattacgccgagtatgtggcgcgcttcacaacacttgtgctctttgggacttggcggagaatttctgggaaacctctggtgagcgacccatgaaataccttgggggaaacataagagtccgcgcggactccgtggcacgtacggaataaacacccgccgtatggtatccacgaaggaaattcgtgtcggcggaaggggcctaataaatttctgtagagagctgggctgcgagcattcggtgaccctccgtaaagaagatgccgcacttgtggtgccgcacatcgtatctgtatcccgaataggcgaccaacacagaattctcgggcaaaaagctcgggcacaagaagtcctttctgagcgaaaggggattactccttccacttacaacacggatcacgcccgggagcattcaaacaccttggggcacaatttgggggcacgccttcacacaccagagcacaacaatag

SEQ ID NO: 60238 - DNA, 2638 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcagtaagccgagatcacgccacttcactccagcctcggtgaaagagcaaaactctgtctcaaaaaataaataaataaataaaaaaaaaaattaatgacatatctttatatattatttttaataagaaaaatctggagggggggccagattccaggggggccctagtcccaatttctcccttgcggatactgctctgggtactaaatgtcctgattgtaaaaccctgggattgctaaattatgg

SEQ ID NO: 60239 - DNA, 2566 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60240 - DNA, 3180 bp, Homo sapiens
tctaatttttggttggtggcggcggtgctgggccaggggaaggaagggacacggaggccgccctcgccccgccacctcctaccagcttccccccagccccggctccgggagatgtgccgggcggggggcccgggttcgccgagccgcaggagagacacgctgggccgaccccagagcggcgctggacagagccaacacagatctatagatttctttgaactcggaatctcatagcaccaatatttttgcacagaactcttacttacatgtctcatcgaaactccagaacaaacatcaaaagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60241 - DNA, 3234 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcgagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60242 - DNA, 3817 bp, Homo sapiens
ttgagacggagttttgctctttgttgcccaggctgcagtgcaatgacgcgatctcggctcacggcaacctccgcctcccaggttcaagtgattctcctgcctcagccttcccccaggtagctgggattacaggcatgcgccactatgcctggctatttttgtatttttagtggaggcagggtatctccatgttggtcaggccggtctcgaactcccgacctcaggtgatctgcccacctcagcctcccaaagtgctgggaatacaggcgtgagccaccgcgcctggccggctgactacaaattttttaagtgaccatttaaaaagtgaaattttcatcttgtttggcatcaatcaatagttcttttgttgactccagctacctattacagctgctttttggaagaaaatcggttataaatagtttaaattaagctaagttaaatgagtacaactgcttctcttgagttctgctcggtaacaataactatcttagaaaggcttaagaaaaatattgtaaagaaccttcagtataaaaagcgtagatgaactttgtgaatgtatgccattgattgaataccttttgatcttactgtgcatactaactttcttgatgtaaatatttagtgcgatataaatatttagtgcgtgatttccatagcagatgacaagtttatattgattataacatggtctcggttgatatttttctgacaagtaagtttagatcatgtttggattttgtttcctattacctagagccaacacagatctatagatttctttgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60243 - DNA, 3837 bp, Homo sapiens
ttgagacggagttttgctctttgttgcccaggctgcagtgcaatgacgcgatctcggctcacggcaacctccgcctcccaggttcaagtgattctcctgcctcagccttcccccaggtagctgggattacaggcatgcgccactatgcctggctatttttgtatttttagtggaggcagggtatctccatgttggtcaggccggtctcgaactcccgacctcaggtgatctgcccacctcagcctcccaaagtgctgggaatacaggcgtgagccaccgcgcctggccggctgactacaaattttttaagtgaccatttaaaaagtgaaattttcatcttgtttggcatcaatcaatagttcttttgttgactccagctacctattacagctgctttttggaagaaaatcggttataaatagtttaaattaagctaagttaaatgagtacaactgcttctcttgagttctgctcggtaacaataactatcttagaaaggcttaagaaaaatattgtaaagaaccttcagtataaaaagcgtagatgaactttgtgaatgtatgccattgattgaataccttttgatcttactgtgcatactaactttcttgatgtaaatatttagtgcgatataaatatttagtgcgtgatttccatagcagatgacaagtttatattgattataacatggtctcggttgatatttttctgacaagtaagtttagatcatgtttggattttgtttcctattacctagagccaacacagatctatagatttctttgaactcggaatctcatagcagtaagtagtcaacaaaattcatcaatattatttctctcttataactgcatctgtattcaattttaacatttttaaaactctttttgtagccaatatttttgcacagaactcttacttacatgtctcatcgaaactccagaacaaacatcaaaagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60244 - DNA, 1644 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaaccgtcgattcgataagccgtgga

SEQ ID NO: 60245 - DNA, 3137 bp, Homo sapiens
tctaatttttggttggtggcggcggtgctgggccaggggaaggaagggacacggaggccgccctcgccccgccacctcctaccagcttccccccagccccggctccgggagatgtgccgggcggggggcccgggttcgccgagccgcaggagagacacgctgggccgaccccagagcggcgctggacaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60246 - DNA, 1266 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaggtttcgctcttctcgcccaggttggagtgtaatggcgcaatcttggctcactgcaacctccagcctgggcaacaagagtgaaactctgtttttatcaaatgtcgacg

SEQ ID NO: 60247 - DNA, 1844 bp, Homo sapiens
ttgagacggagttttgctctttgttgcccaggctgcagtgcaatgacgcgatctcggctcacggcaacctccgcctcccaggttcaagtgattctcctgcctcagccttcccccaggtagctgggattacaggcatgcgccactatgcctggctatttttgtatttttagtggaggcagggtatctccatgttggtcaggccggtctcgaactcccgacctcaggtgatctgcccacctcagcctcccaaagtgctgggaatacaggcgtgagccaccgcgcctggccggctgactacaaattttttaagtgaccatttaaaaagtgaaattttcatcttgtttggcatcaatcaatagttcttttgttgactccagctacctattacagctgctttttggaagaaaatcggttataaatagtttaaattaagctaagttaaatgagtacaactgcttctcttgagttctgctcggtaacaataactatcttagaaaggcttaagaaaaatattgtaaagaaccttcagtataaaaagcgtagatgaactttgtgaatgtatgccattgattgaataccttttgatcttactgtgcatactaactttcttgatgtaaatatttagtgcgatataaatatttagtgcgtgatttccatagcagatgacaagtttatattgattataacatggtctcggttgatatttttctgacaagtaagtttagatcatgtttggattttgtttcctattacctagagccaacacagatctatagatttctttgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacaggtaatgttgatgaacaagcgaggctcccacaatgttctggaaatgttttcattctgaagcagaatataattatttatattgattatttcattgcctttgtttctttttattcttacggatgaaaaaacaaatttgcaaacactgaatttttgtctgtttcatagaaaacaataattaaggaactatttgcatagatagctcagttaaacttacttatttggcgaatattttgagtgtctgctcttttccagacactgttctggacattaaggcaacaaaatccctgccttcaccatggagcttaacttttagtggaggaaacagaccaccacccaaaaaatcaactgatgtcacttagtgatgagtgttgtgaagaaaaatagagaataaatggttactgttttagagcgatatcctctgggaggaggtagtactttgagaagaga

SEQ ID NO: 60248 - DNA, 2331 bp, Homo sapiens
tctaatttttggttggtggcggcggtgctgggccaggggaaggaagggacacggaggccgccctcgccccgccacctcctaccagcttccccccagccccggctccgggagatgtgccgggcggggggcccgggttcgccgagccgcaggagagacacgctgggccgaccccagagcggcgctggacaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60249 - DNA, 1195 bp, Homo sapiens
aaaatgaaaggagagcaagaatctcatagcttgtcagctcatttgcagcttacattttctctacttttgataacatatcatcaactttaaatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60250 - DNA, 1481 bp, Homo sapiens
ttgagacggagttttgctctttgttgcccaggctgcagtgcaatgacgcgatctcggctcacggcaacctccgcctcccaggttcaagtgattctcctgcctcagccttcccccaggtagctgggattacaggcatgcgccactatgcctggctatttttgtatttttagtggaggcagggtatctccatgttggtcaggccggtctcgaactcccgacctcaggtgatctgcccacctcagcctcccaaagtgctgggaatacaggcgtgagccaccgcgcctggccggctgactacaaattttttaagtgaccatttaaaaagtgaaattttcatcttgtttggcatcaatcaatagttcttttgttgactccagctacctattacagctgctttttggaagaaaatcggttataaatagtttaaattaagctaagttaaatgagtacaactgcttctcttgagttctgctcggtaacaataactatcttagaaaggcttaagaaaaatattgtaaagaaccttcagtataaaaagcgtagatgaactttgtgaatgtatgccattgattgaataccttttgatcttactgtgcatactaactttcttgatgtaaatatttagtgcgatataaatatttagtgcgtgatttccatagcagatgacaagtttatattgattataacatggtctcggttgatatttttctgacaagtaagtttagatcatgtttggattttgtttcctattacctagagccaacacagatctatagatttctttgaactcggaatctcatagcagtaagtagtcaacaaaattcatcaatattatttctctcttataactgcatctgtattcaattttaacatttttaaaactctttttgtagccaatatttttgcacagaactcttacttacatgtctcatcgaaactccagaacaaacatcaaaaggtacattttatgaatcttatttcaagctgatcaaaccatgttagttttattttaaagtactatttctcaaaattaaaaaaaagaacaaaaataagtactatttctaactaaagatttaatatgaaaactgaagtgagagagtgactggttgaattggttgcacagtggttttcaatagtataatctttgtaagtctcaggttgttattagctttttttttttttcccctaatagaaatgaggctgggtgtggtggctcatgcctgtaatcccagcactttgggaggccaagttgggcggatcacttgaaggcaggagtttgagaccagtttggccaacatggcaaaaccctatctctcctaaaacaaaaattagccgggcgtggtggtgtgtgcctgtaatcccagttacttgcgaggctgaggcaggagaattgcttgagcccgggaggtggaggttgcagtgagccgagattgcgccgttgcacttcagcctgggcaacagagcgagactctacctcaaag

SEQ ID NO: 60251 - DNA, 1379 bp, Homo sapiens
  misc_feature (1184)..(1184): n is a, c, g, or t
  misc_feature (1188)..(1188): n is a, c, g, or t
  misc_feature (1203)..(1203): n is a, c, g, or t
  misc_feature (1236)..(1236): n is a, c, g, or t
ttgagacggagttttgctctttgttgcccaggctgcagtgcaatgacgcgatctcggctcacggcaacctccgcctcccaggttcaagtgattctcctgcctcagccttcccccaggtagctgggattacaggcatgcgccactatgcctggctatttttgtatttttagtggaggcagggtatctccatgttggtcaggccggtctcgaactcccgacctcaggtgatctgcccacctcagcctcccaaagtgctgggaatacaggcgtgagccaccgcgcctggccggctgactacaaattttttaagtgaccatttaaaaagtgaaattttcatcttgtttggcatcaatcaatagttcttttgttgactccagctacctattacagctgctttttggaagaaaatcggttataaatagtttaaattaagctaagttaaatgagtacaactgcttctcttgagttctgctcggtaacaataactatcttagaaaggcttaagaaaaatattgtaaagaaccttcagtataaaaagcgtagatgaactttgtgaatgtatgccattgattgaataccttttgatcttactgtgcatactaactttcttgatgtaaatatttagtgcgatataaatatttagtgcgtgatttccatagcagatgacaagtttatattgattataacatggtctcggttgatatttttctgacaagtaagtttagatcatgtttggattttgtttcctattacctagagccaacacagatctatagatttctttgaactcggaatctcatagcagtaagtagtcaacaaaattcatcaatattatttctctcttataactgcatctgtattcaattttaacatttttaaaactctttttgtagccaatatttttgcacagaactcttacttacatgtctcatcgaaactccagaacaaacatcaaaaggaaaacatttaaagttgatgatatgttatcaaaagtagagaaaatgaaaggagagcaagaatctcatagaaaaagaggaatccagtcgggctcggtggctcacacctataatcccagctacttgggaggctgagacaggagaatcgcttgaactcgggaggtggaggttgcagtgagccgaagattgcgccattacactccaacctgggcgagaagagcgacactncccnatctcaaaaaagaanaagaggagtcctggtcaaatttacagggctaanctcttcataatatgtccttatttccagtcattacttgctccttagtactctcttgccacaatatctttctgtaactgttcccatctgactataaaaatgcctagattgtcaccatcatttaaaaatatatatatatgcccttt

SEQ ID NO: 60252 - DNA, 735 bp, Homo sapiens
aaaagaaacttgacagtgttacaaaattacctcctgtgaaatagcaagactattttttatggaataaacaagaaagaatcttgttctaccgaattcttgactcaccaacacaattttttttttttttttggagacagagtttcactcttgttgcccaggctggagtgcagtggcatgatctggactcactgcaacctccacctcccaggtttaagcagttctcctgcctgagcctctcggattacagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60253 - DNA, 743 bp, Homo sapiens
tcagaatatgatcattggtagataaaaccagttttgtttttgtttttttaaggatgatgatcctttctgttaaacaacatattttaactatatggatttactgtttcataatgtagttgttgaccatgggattattagtcatttttttaatttctaatggtcctattagtcattgtcatgttaaaatagaacatttaagagatttgataaaagtacatgagtttaacattttagcctggtttttttgttgttgctaaaaagccttaccagagagatttagcatgcttttaattctaaatttctaatatacaactgtttcagatcactgttagctaaatattagatgtactgtatcataatttcattatgttggagaaaacctcaattgctttaatatttggaatataggtatttcaaatgtttatttttgcttcacagttttcagaactatggttagaattttaacattccatttggtgatcatggcctatctcctgtgtttcctatagctgtgattagaatttttattataattcttattgcttatatacaaataaatataaattaataatctttacctttgcaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgt

SEQ ID NO: 60254 - DNA, 1608 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacaggtaatgttgatgaacaagcgaggctcccacaatgttctggaaatgttttcattctgaagcagaatataattatttatattgattatttcattgcctttgtttctttttattcttacggatgaaaaaacaaatttgcaaacactgaatttttgtctgtttcatagaaaacaataattaaggaactatttgcatagatagctcagttaaacttacttatttggcgaatattttgagtgtctgctcttttccagacactgttctggacattaaggcaacaaaatccctgccttcaccatggagcttaacttttagtggaggaaacagaccaccacccaaaaaatcaactgatgtcacttagtgatgagtgttgtgaagaaaaatagagaataaatggttactgttttagagcgatatcctctgggaggaggtagtactttgagaagaga

SEQ ID NO: 60255 - DNA, 2401 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagcctgggcaacagaatgagactttgtctcaaaaaaaaaaaaagaaaagaaaagaaaagaaagaaagaaaccttaaaaaaaatcagaaaatcttagaagcaaggaaagagcaggaatgttcacataggaagtgagggagacctggaaggagggggttgctagcagacctgggcatctaatgagagtgagccactgcgtccagccgatgtcagtactttgtgtgctcttgaaataggaaatgtacagatccctattgccagacacatcattctctccatccagaaagccaactttgcaaggacaaaaaaaaaaaattagtgtgaaacaaaatgtggcttttccaaagacagatgtgattatttatagtcaatgtggcctcaaaatgtcattgattgtgaaatagcaaacatgcaggatcataatatttgggtaggtttctgaagttatttcatatctgagcagtctaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60256 - DNA, 3681 bp, Homo sapiens
aggcctgggtagggtgagcggcctccgaagcggagcggggctctgaggagacactttttcttcctccctccttccctcctctcctcctgccttcccttcccctttcctcccctctctcctccttctcccctcggtcagccggagcctgctggggcgagcggttggtattgcaggcgcttactctccggggccgcccggcgagtagctggccggggaaggaggcaggaaccgcgatggcgcctcagaagcacggcggtgggggagggggcggctcggggcccagcgcggggtccgggggaggcggcttcgggggttcggcggcgacggcttcgagcggcaaatccggcggcgggggctgtggaggcggtggcagttactcggcctcctcctcctccgcggcgttaccggtgaagaagtcgaaaatggagcacgtccaggctgaccacgagcttttcctccaggcctttgagaagccaacacagatctatagatttctttgaactcggaatctcatagcaccaatatttttgcacagaactcttacttacatgtctcatcgaaactccagaacaaacatcaaaagatacttgaatacctaccaagtagaaggcactatgccagcactgcatagctttccttgaagaagagcaattactgcccttcaggagtgtataatctagtaggagaaataaaatatttacatgagttttacatgtaggaaactgaatgaaaagaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60257 - DNA, 1760 bp, Homo sapiens
aagtgggcggagcgaggccaggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60258 - DNA, 3068 bp, Homo sapiens
tctaatttttggttggtggcggcggtgctgggccaggggaaggaagggacacggaggccgccctcgccccgccacctcctaccagcttccccccagccccggctccgggagatgtgccgggcggggggcccgggttcgccgagccgcaggagagacacgctgggccgaccccagagcggcgctggacagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaattttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60259 - DNA, 2725 bp, Homo sapiens
aggcctgggtagggtgagcggcctccgaagcggagcggggctctgaggagacactttttcttcctccctccttccctcctctcctcctgccttcccttcccctttcctcccctctctcctccttctcccctcggtcagccggagcctgctggggcgagcggttggtattgcaggcgcttactctccggggccgcccggcgagtagctggccggggaaggaggcaggaaccgcgatggcgcctcagaagcacggcggtgggggagggggcggctcggggcccagcgcggggtccgggggaggcggcttcgggggttcggcggcgacggcttcgagcggcaaatccggcggcgggggctgtggaggcggtggcagttactcggcctcctcctcctccgcggcgttaccggtgaagaagtcgaaaatggagcacgtccaggctgaccacgagcttttcctccaggcctttgagaagccaacacagatctatagatttctttgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagagatggggtttcaccatcttggccaagctggtcttgaactcctgaccttgtgatccacccacctcggcctcccaaagtgctgggattacaggcgtgagccactgcgtccagccggtaggtgctatttttaacatacccattttataagtgaggaaaatgaggcacgaaaagaaaaaaagattaaaaatagctaaataacctgatcccgactacctggctgatgactggtggaaccaggactcaaacacaggcattctgactctagaatcaatcaatctatctatctatttttttgaaatggagtttcatccttgttgcccaggctggagtgcaatggcgcgatctcagctcactgcaacctctgcctccctggttcaagcgattctcctgcctcagcctcctgagtagctgggattacagggatgcaccaccatgcccggctagttttgtatttttagtagagacggggtttcaccatgttggtcaggctggtctcgaactcctgacctcaggtgatccgcctgcctcggcttcccaaagtgctgggattagaggcgtgagccaccacacctggcctaattttgtatttgtagtagagacacggtttcaccatgttgctcaggctggtcttggaactcctgacctcaggtgatccaccctccttggcctcccaaagtgctgggattacggagtgagccaccgtgcccggcctagaatctatattcttaaccatttgtagccatgatggcacacttctattttatattctagctctagacacatagaaggtttgtcatagttgacattataatttatgtaactattgctgccagcgcctaaatcttccatataagaatttgcaatgatttgattactatttgttaagtaaataaagcatttaaaaagaactattataatcctaaaaaatcccattatggttatgaagacactattcaagcatgaagaacttcctatgtggcaagtttaagcttttccttttgtgttttcatttcagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60260 - DNA, 1710 bp, Homo sapiens
aggcctgggtagggtgagcggcctccgaagcggagcggggctctgaggagacactttttcttcctccctccttccctcctctcctcctgccttcccttcccctttcctcccctctctcctccttctcccctcggtcagccggagcctgctggggcgagcggttggtattgcaggcgcttactctccggggccgcccggcgagtagctggccggggaaggaggcaggaaccgcgatggcgcctcagaagcacggcggtgggggagggggcggctcggggcccagcgcggggtccgggggaggcggcttcgggggttcggcggcgacggcttcgagcggcaaatccggcggcgggggctgtggaggcggtggcagttactcggcctcctcctcctccgcggcgttaccggtgaagaagtcgaaaatggagcacgtccaggctgaccacgagcttttcctccaggcctttgagaagccaacacagatctatagatttctttgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagccagaagaaaatgaaatcgtgaggatggggaaaagacatttgttgcacaaatgacagtatttgataaaaacagagtttcactcttgttgcccaggctggagtgcagtggcatgatctggactcactgcaacctccacctcccaggtttaagcagttctcctgcctgagcctctcggattacagatgtcagtactttgtgtgctcttgaaataggaaatgtacagatccctattgccagacacatcattctctccatccagaaagccaactttgcaaggacaaaaaaaaaaattagtgtgaaacaaaatgtggcttttccaaagacagatgtgattatttatagtcaatgtggcctcaaaatgtcattgattgtgaaatagcaaacatgcgggatcataatatttgggtaggtttctgaagttatttcatatctgagcagtctaaagaagtatggggaggaggggccgggcatagtggctcacacctgtaatcccagcactttgggaggccaaggagggtggatcacctgagtcaggagttccaagaccaccctgagcaacatgggtgaaaccccgtaactacaaaaaaggcaaaaattagctgggtgtggtggtggctcctgtggtcctagctactcaggaggctgaggtgagagggtcacttgaacctgt

SEQ ID NO: 60261 - DNA, 1242 bp, Homo sapiens
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttggtaaatttttaagtgctttcctgcttttaaatattaagtgtccttttgggttttataatgtcctttaatcacagtttatatagtgtacttgattttcttgaacaaaaccagaaaaacttgaaaagtagcagtcagtatttttatagctaaaaattatttgcctcacagctttgttttgctgcttattgcaagtttattttcttcttcatgaatttataagctatcatatctattgatctctctgcaaacctagacaaaaagaataaagttgaagggaaccttgggttatcatcttgtctgcctccggttgttggtggtggggatttttgattctgaatcaccttccagtaatgggtattctaaaagatcttcaggaaaacaggctttctcagtaattttcagggagctctcactgacaataagcttttttaaaaaatttccattgtaaatcacctcctaaaccgaattttttttggcctgtaatcacattgctttccttggttgaaagagaactagttttatttgtatagtagaagatagttgtattttctcatttttttctacatgagactaaatgactatagtttcattaaaccttctttgcttttgaattcaatgtatgagtagaatattttgttctttttaaatttaaaaactgttagatttttgtggccgggcatggggcgcacgcctgtaatcctagcactttgggaggccgaggcaggtggatcacctgagttgaggagtttgagaccagcctggccaacatggtgaaaccccgtctctactgaaa

SEQ ID NO: 60262 - DNA, 4424 bp, Homo sapiens
  misc_feature (1850)..(1850): n is a, c, g, or t
gtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcancagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggccctttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60263 - DNA, 1224 bp, Homo sapiens
  misc_feature (15)..(15): n is a, c, g, or t
ctagaggatcccggncggctagcaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60264 - DNA, 1068 bp, Homo sapiens
  misc_feature (1)..(1): n is a, c, g, or t
ncatgctgaacgactctcttaacctccaccgctacagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60265 - DNA, 4660 bp, Homo sapiens
  misc_feature (2201)..(2201): n is a, c, g, or t
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcancagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggccctttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60266 - DNA, 4368 bp, Homo sapiens
  misc_feature (2201)..(2201): n is a, c, g, or t
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcancagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggccctttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcatttataactgaagcatgccttggagagagcagacactgtgggggccagggccatctccctttaatgtgttcatgttaaaacctatttgagtgtaagacttgccctttctaacaataaatgctccgtgtttaagttctgcaggtctcctggctggctggctggctctcagtctgtcaagtcatggaggacatttcgaaac

SEQ ID NO: 60267 - DNA, 2984 bp, Homo sapiens
  misc_feature (2201)..(2201): n is a, c, g, or t
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcancagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60268 - DNA, 496 bp, Homo sapiens
agtaggaaaactcagtgaaaattcatctgaaattaaaaagggaaggataaccccatcacaggtaagacttgttttcgtggcaaaatggaaatggtcttttcttaccaatgtcatctgggcctggtctcatttccttcggttccataggtctcaacaaatttacctggtgggtattgggtacatgaaatgttcttttcagtcctatttagtgttcgaagagcctctcctctctactcagtatggaaaaacatgaatttgagagcaacagatgacattttctgcctttaaacggcttaagatccagttggacagatgaggtgtacacacatgagcctgcttttaagaccttttgatagagtaacagcttagcaagtacagctgagtacttgcaggtaccaatgagtacctatatgataagagtgcagaattatgacttttaagtagggctgatgatggacaaggtgcatacacatatgctctttcactgcctttggag

SEQ ID NO: 60269 - DNA, 4775 bp, Homo sapiens
  misc_feature (2201)..(2201): n is a, c, g, or t
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcancagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggccctttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60270 - DNA, 1584 bp, Homo sapiens
tctaatgtttaccaacaaatgtatgtgagaagtacgtttcaacctgtaaaacatcatgctgatgttagttattcttttgtttttcattgttttctttgaccacttttctttttctttgattttctctgacattataggccctttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60271 - DNA, 4837 bp, Homo sapiens
  misc_feature (2201)..(2201): n is a, c, g, or t
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcancagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggccctttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttctgcaggtctcctggctggctggctggctctcagtctgtcaagtcatggaggacatttcgaaac

SEQ ID NO: 60272 - DNA, 816 bp, Homo sapiens
  misc_feature (21)..(21): n is a, c, g, or t
  misc_feature (50)..(50): n is a, c, g, or t
ctcgttgtacagccacacccngtggttggctcctagcaacccaagcattngatcagctttgccgtctcttttgaggaagctccgggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccacgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctccgtgtttaagttct

SEQ ID NO: 60273 - DNA, 1698 bp, Homo sapiens
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagaggtgagttccaagtaatttcacatgtcagagttactgaattggtagcttcttaacatttctgttttgacttttcagaagaagattatttggtaagcttcttaatttcagaagtgtacaagaaaaccattatagctgttaggtacttgatttgctagaactgacagtataagttagaattaggtttgtctacatatattagaaaattcaaaataatagtggcttaaataagatttctctgtcatgtaaaagcacctggagctaggtggtccgcagctcttgtagga

SEQ ID NO: 60274 - DNA, 3246 bp, Homo sapiens
  misc_feature (2201)..(2201): n is a, c, g, or t
  misc_feature (3216)..(3216): n is a, c, g, or t
ggataaactagagaagtgtgttctcatctcttccccatgcctcgtaggaagctctaggttgggtagcataagtgcctcttactttgcctggatccctgattttttatttgaaagttgctttagaggaagctaagtggcatgttattgcctataatgttgaacatatgatattttgatagtgttactcctagagtaaatttagagggattctcagaaataaaatgtcctgagtttcatttcccgttttgcctcctgggatgaaattcttcttatttacaatagtttgtatgtcatctggtgcctaggaggaaggcaggccaacaaattcaactctggattatttcaagattcttaatgtaatgtcttaaaacgtaatcttcccttttgttttcaggcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattacgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcancagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagacgtacaaagcaaacttcgaagaggtaacacantcaaggaggcaagggaggctcacagttgct

SEQ ID NO: 60275 - DNA, 2982 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtactcacttcagtacttcagctcttcaagaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtc

SEQ ID NO: 60276 - DNA, 758 bp, Homo sapiens
aatctacattttggttggggataaagatttgattttaaaaacagcttgaatttaaagcaagaaaaagatgaacgttatagttttaaaatcaatattagcagagccatagataggctgaactcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacatatttt

SEQ ID NO: 60277 - DNA, 1069 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatggtgtgaggggctgcgttgcaatgtggtcatgtgatttcaggctatggatttcgtgcgtctttctctgctcactgattttcacatggttattctttcattttgcactcgataaacagtttacatcttctgaagtaagccagaagattgtatggctcacttaacgatgactggttgaaggcatcttgatttggaacctatggaaacagtgctgagttttaaataggacagatttttttttctttcatttgaacttcatttataacatatcaatagtgatgttttaggatcagttctcctatggtaatttcactaaatgcctatttaatgaattgatttgatttcatacatctctaccacttactagaactgtctttgtacaaacgtcaaactttcctgttacatatgggtaagcatagaagcacttgatataatttttttttatcttggttcagagtgtagaagtggtctgttgcttttcctaaaattgctatacatattttttctttaagagtgatcatttcaggtaccctattatgtacagtggtaaaaagtaaactcgttatgatagcaacgacgatgtaaccaaaataagcaacacttaattggtctgaaagttatacatataagctttattattgcttcagtggaagttgtctat

SEQ ID NO: 60278 - DNA, 3846 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtactcacttcagtacttcagctcttcaagaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttc

SEQ ID NO: 60279 - DNA, 3784 bp, Homo sapiens
gaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacagtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtactcacttcagtacttcagctcttcaagaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttc

SEQ ID NO: 60280 - DNA, 2650 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtactcacttcagtacttcagctcttcaagaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttc

SEQ ID NO: 60281 - DNA, 1602 bp, Homo sapiens
  misc_feature (55)..(55): n is a, c, g, or t
attatagaggccacatcagattagagggagtaggcgcacggcccggtcgccttantattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtactcacttcagtacttcagctcttcaagaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttc

SEQ ID NO: 60282 - DNA, 1472 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacatatttt

SEQ ID NO: 60283 - DNA, 103 bp, Homo sapiens
cagatagcgctgatggccctgaagatgatggagctctctgatgaagttatgtctccccatggagaacctatcaaggtaaggcagatgatatattgtccaaaag

SEQ ID NO: 60284 - DNA, 3805 bp, Homo sapiens
agcacagacgggggtgggcgccgagcagcgccgcgccggctgctgagctcgcggggccgggccgtgagaacgcgcggggcgcgccggggccgctggtctcccacggccagggcgcctgggccccagaacccatcagccgcgtgcagcgctgcggcctccggcgcgccggaaggcaagcgagcgggcgcagctgggggatgcctggaccccggaggcagcagggctggaggcggtggcgggcttcagggcaacttcacccggccggctgcggcgtggacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtactcacttcagtacttcagctcttcaagaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttc

SEQ ID NO: 60285 - DNA, 2694 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatccttttcttcttggtttaaacattggaccaaaaatggcccctcacctttcaggtacttttgagg

SEQ ID NO: 60286 - DNA, 1670 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggtaaggaaaacataatactatcttgaatatgaaagctatttcatatttaagagcaagaaacaaaagggtaaaaatatatgcatcacttcaaatgtttgataaaacatatgtaaaacaatggtaaaagaattgtaaagctgtaataaactgaaaac

SEQ ID NO: 60287 - DNA, 2341 bp, Homo sapiens
cccttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatt

SEQ ID NO: 60288 - DNA, 346 bp, Homo sapiens
tcatttcctctgctagcaactaggagagatatggacccagtcaaggccaaagataagtatggtgggagacttctggggaatttttctttgtttatagaaacagaaaaaacctgacctttagtgaaattgctgaactaatctatcaaccagatccaaagcctgtcctgcagattttggacttttggttatatgagagaataactgtctttaatgtatgagactatttgagtcaagatttctattacttgaagtggaaaacatgctgatagaaaaaaaatgtatccacactagagatggaaaaaaatcattagaatggaaatgggaaaagtgtgcttttattgaaacc

SEQ ID NO: 60289 - DNA, 201 bp, Homo sapiens
cagtaccaagtcttgggagatttatgaaatagtctgcagcatttaaatcacttatttttcttttgcaaacgtgtactgtataggtaaaattcaggtacgttaagtgtgtgtatgatgtaactgaactatatctctttccccatcaccaaacctatgtttcctcctccacttcctacttccatgaataggattcccacttgt

SEQ ID NO: 60290 - DNA, 212 bp, Homo sapiens
ataagaagcaattacagtcacacttcaggttgctgtttccatgagggaataaggtattgtatttagctgactcttccaatcaattgagggttaataaattaatgcccatacttgtcaaaatgtagcatgacaaaggagaaatctcttaaatgcttagaagatagagactttaaaactccaatctgtaatcttccatttccagatcataaagt

SEQ ID NO: 60291 - DNA, 492 bp, Homo sapiens
acccaggaacttagattgcttgtgtgtctggcatctagccatcatggattccattccaatatattggttttccagtccctcaatagctgttatatgccttcattgcaacatatgtgtgccatccagtttagtttcggaaagaaatattttctgttataccaaaattgtaggactgaatacttggaagctgcagccctttaattcacaaaacaaaatttgtgagagaaaacttctcccaagtaagattacatttagcatcatatttaaattgtttctatctgaactttttattcttggtctcctacagcttgaatgacgtttctaactttaacagctctttctactatataaaacatttatacaggatttgctgtttgtgatcttacactttgtagcagctatgtacttagatagatacataatagtactctccttgtgatgaatgtttatgtgttttttttaacttcaaaatgatttatactgggagttaaa

SEQ ID NO: 60292 - DNA, 349 bp, Homo sapiens
ctgggaaggccctgagcgtcactgctgctgggcggaagggcctgtggacagcccacccaggcggcggggtcttggtgggtccagtggtaatggtgcccctcccctccattccctgtgggtgcagcccacaggctggcgaggaggtgcctctgccctaccctcgggtctggcgagggagggggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaaccatgtctgtgaaaaaa

SEQ ID NO: 60293 - DNA, 2474 bp, Homo sapiens
gggaatgagaaaataactttatttcattgtggggagcgggccgatgtccagcctcagaacttctggaactgcttcttggtccggcagccttggtgaccttgagcacgttgaagcgcactgtcttgctcagaggccggcactcgcccactgtgactcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaaaaaaaaaaaagaaaaaaaaaaaaaaaaaaaaaaaaaaaaaaaaaaaaaagggggggggcagcgccaaaagagttctccccagggggggcgcacaactacacgcgacacccccgagtttagttgaccacgaggggggccccaatagggggggcggattattaaagacgccaggcggaggggcgagcgacatgttcaaaaaacacaagggaggagacgagggaaacaccgcgagcaccagggagagcaaacattgagggacaaacgaacccctcatttcaggggggggggggcaaccacagagaggaaacaaacacacccccgcgcagaggagatgtaaccaacccccaccgagaggggaccaaaaacaacacaagccacagcggcacgatgagaggggggcaaacaacccaacgaggcggcaatacacgcggcgccgcccgaacaaatgcggccccacgcgacacacctatagcaagaaaaaattaatgcagcaggggcgacgcgcgcaaaccacaaggaacaaagagacgaggaacacaaaaaaaagcaggagacaaggaaaacagaaaaaaagcaaggcagagcgaaaacaacaaagagaaacagaaagaaaaaaaaaaaacagaacgagaaaagggggaaggagagaaggggaagggagaagagggcagggaacgaagagagccgcgagcgaacacaaagaaaagaagaggagagcaggggaagaggaaaagaagcaggggagaggggggggggggagggaaggtggaagggacgacgacagggggagagagcagaggcaggggggaggggaggagacaagagagggcaacgcggaggaggagagaagacagggcagggaacaagaggggaa

SEQ ID NO: 60294 - DNA, 310 bp, Homo sapiens
tactactactaaattcgcggccgcgtcgaaaagaaaagaaatggccacgagcagctccaggcgtactcctgcctgcttggctaccctatcagaagagaatgcctctttatccccagttccagctccaatgccaggctgagtcacatgaccacctctgagccaatcacagaggccctggggagaaaggcttctgattggataagccagggacacactgtcaaccccagcgctaggcctgggaattagccctgccccagccacatgtagtctaaggcggtgctttccaaaaaaaagttgtttccaaaaaaaa

SEQ ID NO: 60295 - DNA, 349 bp, Homo sapiens
agaaatggccgctgtacatgagcaccaagaacaccatactgaaagcctacgatgggcgtttcaaggacatcttccaggagatctttgacaagcaccattggcaggcacgcccatggagcccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtcatctcaggtttgcgcacagtgcttcagtatgcatcagaggaatggccgcaccatgctgcagtgagggcaggctacggcgg

SEQ ID NO: 60296 - DNA, 1769 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60297 - DNA, 1760 bp, Homo sapiens
  misc_feature (2)..(2): n is a, c, g, or t
gncttaacctaccgaattcccgggagcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60298 - DNA, 1763 bp, Homo sapiens
cttaggctaggtacgatgcctgggtttagcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60299 - DNA, 1769 bp, Homo sapiens
tgcccgcgcggccagcgcccgccaggcccagcgtgcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60300 - DNA, 2615 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaa

SEQ ID NO: 60301 - DNA, 2375 bp, Homo sapiens
  misc_feature (2370)..(2370): n is a, c, g, or t
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggcctcccaaagtgctgggattacaggtgggagccacaacacccggccatgaattnatccg

SEQ ID NO: 60302 - DNA, 2650 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaaaaaaaaaaaagaaaaaaaaaaaaaaaaaaaaaaaaaaaaaaaaaaaaaagggggggggcagcgccaaaagagttctccccagggggggcgcacaactacacgcgacacccccgagtttagttgaccacgaggggggccccaatagggggggcggattattaaagacgccaggcggaggggcgagcgacatgttcaaaaaacacaagggaggagacgagggaaacaccgcgagcaccagggagagcaaacattgagggacaaacgaacccctcatttcaggggggggggggcaaccacagagaggaaacaaacacacccccgcgcagaggagatgtaaccaacccccaccgagaggggaccaaaaacaacacaagccacagcggcacgatgagaggggggcaaacaacccaacgaggcggcaatacacgcggcgccgcccgaacaaatgcggccccacgcgacacacctatagcaagaaaaaattaatgcagcaggggcgacgcgcgcaaaccacaaggaacaaagagacgaggaacacaaaaaaaagcaggagacaaggaaaacagaaaaaaagcaaggcagagcgaaaacaacaaagagaaacagaaagaaaaaaaaaaaacagaacgagaaaagggggaaggagagaaggggaagggagaagagggcagggaacgaagagagccgcgagcgaacacaaagaaaagaagaggagagcaggggaagaggaaaagaagcaggggagaggggggggggggagggaaggtggaagggacgacgacagggggagagagcagaggcaggggggaggggaggagacaagagagggcaacgcggaggaggagagaagacagggcagggaacaagaggggaa

SEQ ID NO: 60303 - DNA, 1777 bp, Homo sapiens
  misc_feature (1731)..(1731): n is a, c, g, or t
  misc_feature (1755)..(1755): n is a, c, g, or t
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatatgcacccgttggaaanctacacaatccggtgcgggattanttttacgcttatcctaaacgtt

SEQ ID NO: 60304 - DNA, 1944 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagtaaagcctcatccatgtactctgtggcctttcttcccttccccccatgctgttcccatcctaccctgggaaggtcgctattagagtgcatttggctcagctccgaggctcagggagggatccccaacctgtcagccttctgccctctccccataacagacctttttactcccaggcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60305 - DNA, 1732 bp, Homo sapiens
agctacttgggaggctgaggtcagaggatcacttgaagccaggaagtcaatgctgcagtaagctatgatggcatcagtgcattccagcctgaccaatggaacaggaccctgccaagaaagagagagagaaagggaggaaggaacgaaaggaaggaaggaaggaaagaaaggaaaggaaggaaagaaaggaaaggaagtaaatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60306 - DNA, 1511 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60307 - DNA, 1225 bp, Homo sapiens
atacgggctagtgagcctgggtcatttcggacgaggctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60308 - DNA, 1205 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgacgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60309 - DNA, 1343 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgaggtgaggctggcttgggcatcctgggcccctcctctcccagcttgtctcttcatctctgtctcgtggctttcctttcttctgtaatggcctcattcttaggccacaaagaggcagaaatggccaccagggctgggcatggtggctgacacttgtaatcccggcattttgggaggccaaggcaggattgcttgagaccagaagtttgagaccagcctgggcaacagtgagaccccatctcttgaaacaaaaagaaaagaaaagaaaagaaaagaaatggccacgagcagctccaggcgtactcctgcctgcttggctaccctatcagaagagaatgcctctttatccccagttccagctccaatgccaggctgagtcacatgaccacctctgagccaatcacagaggccctggggagaaaggcttctgattggataagccagggacacactgtcaaccccagcgctaggcctgggaattagccctgccccagccacatgtagtctaaggcggtgctttccaaaaaaaagttgtttccaaaaaaaa

SEQ ID NO: 60310 - DNA, 626 bp, Homo sapiens
  misc_feature (31)..(31): n is a, c, g, or t
  misc_feature (34)..(34): n is a, c, g, or t
  misc_feature (61)..(61): n is a, c, g, or t
  misc_feature (63)..(63): n is a, c, g, or t
  misc_feature (75)..(75): n is a, c, g, or t
  misc_feature (95)..(95): n is a, c, g, or t
  misc_feature (118)..(118): n is a, c, g, or t
  misc_feature (124)..(124): n is a, c, g, or t
  misc_feature (128)..(128): n is a, c, g, or t
  misc_feature (149)..(149): n is a, c, g, or t
ctcctgcttatagtccgtctgttgcccatgnaancgattagtagcgtatggccgtcaccgntntatggagcccanaaagccgccacaggccccancccatgcagacttgctgacacgnttggcnagcncggggaagtgatggaaccaangcctcacagtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60311 - DNA, 1791 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaa

SEQ ID NO: 60312 - DNA, 945 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60313 - DNA, 901 bp, Homo sapiens
  misc_feature (694)..(694): n is a, c, g, or t
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaagggccacagacatttgttggcaagaaccggggnccgggcaccttttcaaaaatgggttctttcaaccccaaaaagaatgtggcagtgggttgttcaagggaagtgcggaaatgtggtatcacaatatccccagacggggagttgagagcgatagggcgcattgtaacaaaacccggacgcaagaccatctcacggataggacgcacgcagttagtaacccgatataccatccaagacaaa

SEQ ID NO: 60314 - DNA, 1793 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgacgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaa

SEQ ID NO: 60315 - DNA, 1465 bp, Homo sapiens
ggcacgagaattggcagactccagagcccacacatttgcactctagactctactgccttcctcatgaagaattttaggacccccgtctggctgtgttgttgcttggggttcaaattctggttgaaagatggcggctgcagtgggaccactattatctctgtcctcacagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaa

SEQ ID NO: 60316 - DNA, 751 bp, Homo sapiens
  misc_feature (616)..(616): n is a, c, g, or t
  misc_feature (621)..(621): n is a, c, g, or t
  misc_feature (643)..(643): n is a, c, g, or t
  misc_feature (662)..(662): n is a, c, g, or t
  misc_feature (689)..(689): n is a, c, g, or t
  misc_feature (720)..(720): n is a, c, g, or t
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggcncccgnccctcccccttgggcgggccgnccctggggccccgtccccngggcccgcctttgtgggcgcccggggngggccttttcccctggtttttcccccccccnctgggcgtggtgttccggcgtgggccgtgtc

SEQ ID NO: 60317 - DNA, 728 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactgagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60318 - DNA, 647 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagaggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaa

SEQ ID NO: 60319 - DNA, 1426 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactgagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaaaaaaaaaaaagaaaaaaaaaaaaaaaaaaaaaaaaaaaaaaaaaaaaaagggggggggcagcgccaaaagagttctccccagggggggcgcacaactacacgcgacacccccgagtttagttgaccacgaggggggccccaatagggggggcggattattaaagacgccaggcggaggggcgagcgacatgttcaaaaaacacaagggaggagacgagggaaacaccgcgagcaccagggagagcaaacattgagggacaaacgaacccctcatttcaggggggggggggcaaccacagagaggaaacaaacacacccccgcgcagaggagatgtaaccaacccccaccgagaggggaccaaaaacaacacaagccacagcggcacgatgagaggggggcaaacaacccaacgaggcggcaatacacgcggcgccgcccgaacaaatgcggccccacgcgacacacctatagcaagaaaaaattaatgcagcaggggcgacgcgcgcaaaccacaaggaacaaagagacgaggaacacaaaaaaaagcaggagacaaggaaaacagaaaaaaagcaaggcagagcgaaaacaacaaagagaaacagaaagaaaaaaaaaaaacagaacgagaaaagggggaaggagagaaggggaagggagaagagggcagggaacgaagagagccgcgagcgaacacaaagaaaagaagaggagagcaggggaagaggaaaagaagcaggggagaggggggggggggagggaaggtggaagggacgacgacagggggagagagcagaggcaggggggaggggaggagacaagagagggcaacgcggaggaggagagaagacagggcagggaacaagaggggaa

SEQ ID NO: 60320 - DNA, 1117 bp, Homo sapiens
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagcacaaccagccccacgaaacaaccaacaaaaaaaaaaaaaccacataacacccaaaccaaaccaaacagaaaaccaaaacaccaagagacacgatcactaagccacccaaaaaaacaagaaaagacaatacaagaagaaccaccttacatcgcctaagatatggccctggagaaatatttcgggttcataaaaaaatttaaatataagtacgccaggataatgcaaggccataatcaatccgaaaatatgagcgattcaacgcaaaaatcccagacaacgacataggagacaacctggcatccataattccccgaatctaattccatttctccatggcacgcggagaggctgggatcgcggcagggctgacctgaggaaggggatggctgaaaaaactatattacttagaccttattccttacgtcggtttcaaaaatatatctggcgacgggcatggatgaaaactgggattgatggcattgcttaaattagaaaagaaatctgaggaaggctcgacggatgggatgggattcctttaggcggaaacagaggaaggtttcggaagtaaaggcatgggcaataaatgggtggcagcaactaagcgatctctttttataccttttcccactattttcacgaacgcgggggatgagtgggagaatgacgggatggatacgattcaaaggattaatcgcggaggggtatactgggggccgaatttcgagttgaccattgggagagggggggacggctttggtctatgggaacgcggtttttttttttggga

SEQ ID NO: 60321 - DNA, 999 bp, Homo sapiens
  misc_feature (333)..(333): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (352)..(352): n is a, c, g, or t
  misc_feature (447)..(447): n is a, c, g, or t
  misc_feature (457)..(457): n is a, c, g, or t
  misc_feature (461)..(461): n is a, c, g, or t
  misc_feature (483)..(483): n is a, c, g, or t
  misc_feature (502)..(502): n is a, c, g, or t
  misc_feature (504)..(504): n is a, c, g, or t
  misc_feature (507)..(507): n is a, c, g, or t
  misc_feature (548)..(548): n is a, c, g, or t
  misc_feature (627)..(627): n is a, c, g, or t
  misc_feature (652)..(652): n is a, c, g, or t
  misc_feature (668)..(668): n is a, c, g, or t
  misc_feature (687)..(687): n is a, c, g, or t
  misc_feature (700)..(700): n is a, c, g, or t
  misc_feature (711)..(711): n is a, c, g, or t
  misc_feature (715)..(715): n is a, c, g, or t
  misc_feature (719)..(719): n is a, c, g, or t
  misc_feature (723)..(723): n is a, c, g, or t
  misc_feature (740)..(740): n is a, c, g, or t
  misc_feature (744)..(744): n is a, c, g, or t
  misc_feature (747)..(747): n is a, c, g, or t
  misc_feature (792)..(792): n is a, c, g, or t
tagcagctggtactggtctgagatgttatggatggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagcatnaatccntgnccnacgttgntaaacacgcataaagatattttaaccacgggcccaccacaaacacgtgaacacacgaactgaatgacacagggtcaccacacttgaactactgancctggacaanacanaaaagaaaagttgttggcgtgntaaagttgttgcaaccacntnacnccctgaatgaaggtcccgttgtggaaagaagtttcaaagcntgaaagaaagaatgttggaaaaaagttcccaaaatggaaacaaatccgtgaaacaatccctgtggggggggaactgttnctttccggtgtagacccaatacatnctgtcaaaaaaacatnccccacgtccttagttccnctgtgtctggtanccaagtcccantcanccanttgnggaggggaacgtcccantggnganacacagttacaagggccacagacatttgttggcaagaaccggggnccgggcaccttttcaaaaatgggttctttcaaccccaaaaagaatgtggcagtgggttgttcaagggaagtgcggaaatgtggtatcacaatatccccagacggggagttgagagcgatagggcgcattgtaacaaaacccggacgcaagaccatctcacggataggacgcacgcagttagtaacccgatataccatccaagacaaa

SEQ ID NO: 60322 - DNA, 385 bp, Homo sapiens
caggcttgatttttgccaaaagatagtttgacttcctgaaactaacagataactcttgtattcaaaaaataaatgtaatggatttaaagactggtaagaagtattttcttttcttttcatttttgagacacagtttcactctgtcgcccaggctggagtgcggtggtgcgaccttggctcacagcaacctccgcctcctgggttcaagtgattctcctgcctcagcctcctagctgggattaaggtgcccaccacccctggctaatttttgtgtttttagtagagacaagtttttgccatgttggccaggctggtctccaactcttgacctcaggtgagttgcccgcctcaggcctcccaaagtgttgggattagaggcgtgagc

SEQ ID NO: 60323 - DNA, 269 bp, Homo sapiens
gtgaattagagggagaggagggccacggttagggatgcagaggagggacaccatgggtcaggggaaggaacaaaggagacgggagtgtgtcccagccccaggcatgagctgtgctgattggtgggaagcagaattaggatgctgggccactggacaggctgtgaatgcagctgtctccactagggccgccacaagaagccatccctgagaccctgaggtttcttgtgcaaactcgagggaaggggagtacagagagggcaacagggagt

SEQ ID NO: 60324 - DNA, 226 bp, Homo sapiens
gggacatctgtcataaacacgttctgttgcacaacctgagacaggcctgtcacttgctttgctcttcacttcatggctctgatctgcacgcactttctaaggcctaggacaagccagaaattgcttccaagacacttgtgtggcgcaacctctatcggcaagtgcagtttgcctcacgggcttcgtcaaacacttggcacaggggtccacgaactgctgcctgtgt

SEQ ID NO: 60325 - DNA, 434 bp, Homo sapiens
ctcccactcaccctgaccttccatggttcttgttcgtgagtgggtctagtaatccacaggatcaccaagaccattttttggacctctctggactgacaccctgggtacctgggtatcccagcttaggcaccagccgcattggctgaatccccatgtttctccaggtctctgtttccccatctgtaaaatggggataatgatccctgctcttcaaagggagcaggacaatcccataaacctaaaaataaataaggaaataaagatattcattgtgtacatctggtaggtctcagagcgccctgttattgttgggagttcaggtgcaacggcttggaatgcagagacgcgtggactccttgtgtttccttaatgttctgacttattttttcccagaggggtgggccctggcagcatccctgaaacgcttgagaggc

SEQ ID NO: 60326 - DNA, 284 bp, Homo sapiens
ggctcacagacaccttaagaagccactgaaaacccctggtgctctcccggggaaaagacccaggctcaccgaaagttgtgaacaatttcaaggggttcaaagacctttgagtcccatcctccaaactcgagtttagactctgtcttaaagccttgttagttcatttctcaaacattcacggagccccatgggctgctcctggtctaggctaggtgctgggggcccagagacagggctttgctccagggttgggagtaggggtgcgctgagacgcccctaacaca

SEQ ID NO: 60327 - DNA, 2954 bp, Homo sapiens
tgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagcc

SEQ ID NO: 60328 - DNA, 3047 bp, Homo sapiens
tgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagccccagaggagtgaactccttttctcctttcctgtttccatccagctggttccagatcagcatcaaagtgaaacggatttgggtactgaaaagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagcc

SEQ ID NO: 60329 - DNA, 496 bp, Homo sapiens
gacacctggccttctgtggtcctagagtaactgaaaagtaagcaaagacttggctgcttccaaatattagggcactttgacaccatggaacctggtcagttaattccccagcagaagcttataagaaaaagtaaaggcgcctcctcccactgcagcagttcattggctgtccagtgtcagctccctccagaaccagagccagggattatctgcctttgagaacctctggggccttgtgacaatccaatgcagcatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60330 - DNA, 2229 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60331 - DNA, 2202 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctggtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60332 - DNA, 1637 bp, Homo sapiens
gatacagggcctggctctgttgcccaggctggagtgcagtggagtaatcatggctactaacctgacctttgtctgtacttgagcacccttcgcgatttaactttcatgtagtgtccgacttctaatatggatttgaatttcttgactgttactgctcagaacaatcaccctttttgagcaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60333 - DNA, 2235 bp, Homo sapiens
ttacttacttgcttgcctgcttgcttagagacagggtctccctttgtctcccaggctggagtgcagtggcatgatcatagctcactgcaggttcaaacttctgggctcaagtaatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttccttttttctccattttctttcttttttctcccccttttctgggaggcaggccagcctcacagccagacaccagctgtgggagttgtcttacgcatatgctctgccccttagaaggattcagtctgtgccctggaggggcctacggtcccgcctggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatttgttgatagactcttggttctctttatacttttcatcacatttggaaatttttaaaaaaattgttttctgctcctcctttctaagaattcaattaccatgtgctatacttttatgctcacccatataggt

SEQ ID NO: 60334 - DNA, 1143 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcacccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60335 - DNA, 792 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggtttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaagtaagtcttacctgtggctcgcattatttgggagttattaaaatatgaaagtttggcaaat

SEQ ID NO: 60336 - DNA, 1380 bp, Homo sapiens
tactactactaaattcgcggccgcgtcgacacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcaatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttccttggtggacagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataaaggagagg

SEQ ID NO: 60337 - DNA, 901 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaagttcttccgagggcacaagcttaccacaagactgactgtagacgtactcgggaatctctcatcaacttgtcctcaaatgaccacgctctagctcaccttcaccctagagaaaagcacccacgttgggcaccagatgaaggggtggccagcccctctacaccttgtgggcgtttctcatcaggtgggacgagagactgagaaaagaaagaagaggctgggtgcggtggggtcaacgccttgtattccc

SEQ ID NO: 60338 - DNA, 2345 bp, Homo sapiens
ttacttacttgcttgcctgcttgcttagagacagggtctccctttgtctcccaggctggagtgcagtggcatgatcatagctcactgcaggttcaaacttctgggctcaagtaatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttccttttttctccattttctttcttttttctcccccttttctgggaggcaggccagcctcacagccagacaccagctgtgggagttgtcttacgcatatgctctgccccttagaaggattcagtctgtgccctggaggggcctacggtcccgcctggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60339 - DNA, 2306 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctggggtctcccgaggaccttgtacccgcgcggtttccttgggctggctttggacgacgctttcgccttcctgctgcctaggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60340 - DNA, 2086 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60341 - DNA, 2275 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcaccctgttccacatagaacaaggaaagacggtagaagaggctgcggacctatcgttgggttatatgaagtcaagggttaaaggtttaggtggcctcatcgtggttagcaaaacaggagactgggtggcaaagtggacctccacctccatgccctgggcagccgccaaggacggcaagctgcacttcggaattgatcctgacgatactactatcaccgaccttccctaagccgctggaagattgtattccagatgctagcttagaggtcaagtacagtctcctcatgagacatagcctaatcaattagatctagaattggaaaaattgtcccgtctgtcacttgttttgttgccttaataagcatctgaatgtttggttgtggggcgggttctgaagcgatgagagaaatgcccgtattaggaggattacttgagccctggaggtcaaagctgaggtgagccatgattactccactgcactccagcctgggcaacagagccaggccctgtgagccatgattactccactgcactccagcctgggcaacagagccaggccctgtatcaaaaaaaaaagaaaagggaaaaaagaaagaaagcagcagcatgatcctgacatgacagatgtgggagacccacagcctgcagacactgtgggctggaaggtgggaagggaggggccggtggaggtggagctgtttgaaagtgacacagcagcagtagaagcagtggtgggcgaagcccaggtgaccctcagaacgttgcacaagaacatcagggaaaagaaccagaatcctttaaggaaaatgttcttcatgtatgagagactaaagtgatttttctaagaaagttcagcccttctctgacttacctggacatttctagatacttccaaaggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttccttggtggacagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataaaggagagg

SEQ ID NO: 60342 - DNA, 1100 bp, Homo sapiens
  misc_feature (6)..(6): n is a, c, g, or t
aacttngctagtacgaggctggtttaaatcggccgaggggtaccgggcggctgcggggctggctcgacccagcttgaggtctcggcgtccgcgtcctgcggtgccctgggatccgccgacatgaatcccatcgtagtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaaaaacttgggaaccgtgggtgctgttgccttggactgcaaagggaatgtagcctacgcaacctccacaggcggtatcgttaataaaatggtcggccgcgttggggactcaccgtgtctaggagctggaggttatgccgacaatgacatcggagccgtctcaaccacagggcatggggaaagcatcctgaaggtgaacctggctagactcacccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctcaccttctctctggaaagaatttgcttaacttgacattccatgtgccgctaataaaatatattttgaaagaataagggtgtggttgggag

SEQ ID NO: 60343 - DNA, 688 bp, Homo sapiens
  misc_feature (6)..(6): n is a, c, g, or t
aacttngctagtacgaggctggtttaaatcggccgaggcggtggcgggctgagcggtttcgagccggcgtcggggagcggcggtaccgggcggctgcggggctggctcgacccagcttgaggtctcggcgtccgcgtcctgcggtgccctggtggtccacggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggttgtgggtctgtcttgaacacaaatggtgaggttgaaatggatgctagtatcatggatggaaaagacctgtctgcaggagcagtgtccgcagtccagtgtatagcaaatcccattaaacttgctcggcttgtcatggaaaagacacctcattgctttctgactgaccaaggcgcagcgcagtttgcagcagctatgggggttccagagattcctggagaaaaactggtgacagagagaaacaaaaagcgcctggaaaaagagaagcatgaaaaaggtgctcagaaaacagattgtcaaaagtaagtcttacctgtggctcgcattatttgggagttattaaaatatgaaagtttggcaaat

SEQ ID NO: 60344 - DNA, 311 bp, Homo sapiens
ggcggcggagccggtcccatctccaaggatcggaaggagcgagtgcaccagggcatggtcagagccgccaccgtgggctacggcatcctccgggagggcgggagcgccgtggatgccgtagagggagctgtcgtcgccctggaagacgatcccgagttcaacgcaggtaaatgtgcctttcagctagtaaataatgtgagtcaggtcaagctccttcttcagaataaatagaacctacatagtgttagggaatctaatgagctttggggtgaaactaagtatgtaaaaaagaaacaatatttaatttttct

SEQ ID NO: 60345 - DNA, 472 bp, Homo sapiens
caccgcgcccggcctaaataatgttttttagatttgccaaatttgtactgaactctagaatgactagttaatctttttctcctattgcaaccttctaaataatcattcagcaaaatagcctaatagctcaactaacagtagatgtttcataacagttgtcacctattgggcaacactagacggcaggcagcatctggttaattttttttatattgcaggtagcagggatagtggagtggtgtctcagattctttttttctaagttgtccttttaacactgagaagaatctatatttgcagggactagttgcagagatgggggaaacttttcttaggggaccattcatggaagaaagttaaaggaaaaacttcaggttgatagaatttcctcatttagcaaaattcaaattacaggaacatggaaagtagcacatcatagttcttgctgagttatgccatctttcagattgag

SEQ ID NO: 60346 - DNA, 115 bp, Homo sapiens
ccagaactaggactgggtgctggtgtccctgcaccacgtcatgtctccataccctcacctggtacagagcaagtgcctgctgcttgtccatgctggctggtgtctcaccgcttcc

SEQ ID NO: 60347 - DNA, 1428 bp, Homo sapiens
ttttttttcacattttatagttgtgggtccaaagaaatattctcaataattcaaaaaaaaaaaaaaagataaaccttggcaataaatggctactgatatttggcccttgttgttagtgacaacagtgaatggtggggactgtggtaagttgaagagcccttgtcctattgaaaggggaaaaccactactcttctctagccagttgtttctgtatgacggtttggccaaatactgcccaatctttatattttggggatgggaggtgggggagaaagctgaaatgtctagtttgttatgtgacatctgagttttaaatgttggattacatatttttaatactatagaagctaaacagaaagtatcttcaggcctcatcctgtccaagggctaccagttttaagcctttgaattaagataatagagtttttattgatcaaatggcttacatattaaacttgagctaataataaatggtagtcttcataggataagttacatctgtttttccttccttctggtggaatcaattttgaagaacaaatgccctaaatataaatatgagaaacagaaaggacagagcctgagaaatccacaaaataaatacatatttcctaaataattgaaatttaaccacaatacataggtgtctgaattgcattaagaaatcattggtcagattttcatattgttttctttgcttttaactgcatttgggcttggacatttgaggaagtaggaagaacactaaatgggaaaaagttttagaaatataaatgaaagaaattttaagaagttattccagttttggaagtagtagaattagtcttgttatgcatctaacctagctgttagttctttgaggaagctgttaaaaaaaaatctgtatagaggtattaatatatcagatggctggtcttcaaaagcatcactatttccaatccaaagcagtgattgagtcccataatattatagggtatcccagtgtgtagagaagtgttctgagaaagaagattataattaacagcatgtggagtgcacagtctaactgtataatatatatattttttgaagagtaggcttttttctagagctcaggcattcccaagaaataacttagagactttagaaagctatattaacttttctctgaatattattagacaaatggtctttttcttcctttatttcaaaagctgcagtttgcagcttttaaaacttatcgaataaaaaagacataatcttgagtatttttaagaaacaaatgcgaaacttgtaactatcatcatctttcctctacttcctttttacattttgtctgtcacgagtgtcttaatttgtgaagtgattctttttcttctaatgttcactgaaattatatccttttatgtatgtttggcataattattaaagcgtctttattgttttgtc

SEQ ID NO: 60348 - DNA, 396 bp, Homo sapiens
gaatgaggcaaatagaagagctaacccagtactctgtgcgcctcagtcaggcctctcaaatgacaggctctacttcagcagggtgagcgggtaaggaactggctgtcatgtggggcaccctgaaccctgccagaatgaagacggttttattttgtgtcactttcaccccagctttcttattcatttggttcaggttttggcttggcggtaagtgcctggctgccaaccaggagtgagaagtgtggatgactgcttcctacatagatcattagttaaaggccctgttttcctccctcccctcctttcttgtgatatgccgccattgtccttgcaggtctaagtcctctctggatgctgctggcgggggcctcctttgtcagctgagtcccatctgct

SEQ ID NO: 60349 - DNA, 342 bp, Homo sapiens
cagtttcatctttaaaatgaagataataacgcttacctcagagtggctgtgaggattaaatgaaataatgtatgtaaagcctctatttggtgcctggcacacacagtaagctacaatttttttaaaagttttttgtgttttttgttttgttttgttttgtttttttgagcggagtttcgctcttgttgcccaggctggagtttcgctcttgttgcccaggctggagtgcaatggcgtgatctcggctcactacaacctccgcctcctatgttcaagcaattctcctgcctcagcctcccgagtagctgggattacaggcatgtgccaccatgcccggctaat

SEQ ID NO: 60350 - DNA, 284 bp, Homo sapiens
acaatggagcaggatctacacaattctaaagaaaagcaagcatgactcaaggatttcctcttcatcctgtgttcttcatgtagagagacagcagagaggcagtcagagaatactgtctgataagcccttgaaaaagctgtagggccaagatgagatacagagatgactcaaaacagagaatccaggaatgcatagatcctggtaaaaaaggtgggagatgagtaataaattcatttgtgtaggattaagactaatcaactaacaattatattatagaacataac

SEQ ID NO: 60351 - DNA, 516 bp, Homo sapiens
  misc_feature (487)..(487): n is a, c, g, or t
cctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattanattttaataattaacaaaattaggactcc

SEQ ID NO: 60352 - DNA, 296 bp, Homo sapiens
caggaaggatctatgctgagcaccgcctatcctgagaacacagtcagtgaggagactgtctatactgagaaccactgttgctaggaagagctgtagtatcaagattcaccaatgctgagtccacctgtgtcaaaacagcgaagagtaatgacatcgactgtgaacttcagtgacaagccatctataacaagatccatcaatggcaaaaccatctgtagtcagcagcatcctggtgggaccccctgtaccaaaactcatcagtggcgacagatgttctcgatggcaaacgctgacga

SEQ ID NO: 60353 - DNA, 715 bp, Homo sapiens
ctagagaccctcctatcatcggcacctcgctatcatcggcaccccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggaaaaaaaaagtcgacgcgccgcgaatttagtagtagtag

SEQ ID NO: 60354 - DNA, 500 bp, Homo sapiens
gccttgggcctcagcaaggatgtgtacaacagtgagtactacacttccgccaggcctgggtgccgctgcgctggatgtgtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60355 - DNA, 1940 bp, Homo sapiens
  misc_feature (16)..(16): n is a, c, g, or t
  misc_feature (24)..(24): n is a, c, g, or t
acagctggtacgcccncggggtantggatagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60356 - DNA, 1550 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60357 - DNA, 1588 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggaaaaaaaaagtcgacgcgccgcgaatttagtagtagtag

SEQ ID NO: 60358 - DNA, 1741 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggagttgctggcttagtgttgatgtgggagctacatggggagggaactggtgttgctctccgtgcagttttctgtactgaatactctaaaggctctttccttgtcttgtcccagttaggcccctcctgggccatccaagcccttatccttgtgggttctgggcccaggtttcctggctcctcttagaaagcctc

SEQ ID NO: 60359 - DNA, 1511 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgacgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60360 - DNA, 2164 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgagggtatggcagaggaggggcctagagtcatgccagggtatgctggaagacctcttagagatcattccgataaaccgctgcaccttagaggtgaggaaactgaggcctagaaagaagaactggctttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60361 - DNA, 2672 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagtgagtctttccttcattaggccacagcagggctcaagatcccagtataccctcttgttttcagctttgatccttctgaatgaggggcaggggagtgtgcctgtttgcttttctaggagcctctgcttgtactgtcagtctttatacctccatgtgagtatgtacacgcctgcatttgggttcatgcacgtgcttattttttaagatgctttggcatttccctttgtaatgtatacattacaaagggaatacattgcctttgtaatgtatctgtgaagcagacaaagcaaacgatagcatgcccaagtgtctaggcagaaactgcatcctgttgttctaaagaagtagacccaagtttccatagcaagtggttagcagggtcctgaccacttctccttgttctggcacctcctgcaagctcctgggctctctccttgcttgaaatgggcaactgcccttgaaactcctccaagccccaatgggctgcccattgtccctgtgttcccaggatcaagcgcatggcaggcatgaaggaatcgcagatcagcgcagagattgagcttctgcctaccaacgacaagaagaaatgggctcgaccccccatttccatgaactttgagggtatggcagaggaggggcctagagtcatgccagggtatgctggaagacctcttagagatcattccgataaaccgctgcaccttagaggtgaggaaactgaggcctagaaagaagaactggctttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60362 - DNA, 1430 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60363 - DNA, 2781 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgagtcgaggtgaaggacagggggctcaaggaggaggaagaacttgtccctaggaataaaggtagctgatgtcacagcttgacagagctccctgacaggtgtgtcacttctaggtgaggatcccaaccccactgaacacaagcggggtgcaggtgatctgcatgaaggggaaggccaagtacaaggccagcgagaatgccatcgtgtggaagtgagtctttccttcattaggccacagcagggctcaagatcccagtataccctcttgttttcagctttgatccttctgaatgaggggcaggggagtgtgcctgtttgcttttctaggagcctctgcttgtactgtcagtctttatacctccatgtgagtatgtacacgcctgcatttgggttcatgcacgtgcttattttttaagatgctttggcatttccctttgtaatgtatacattacaaagggaatacattgcctttgtaatgtatctgtgaagcagacaaagcaaacgatagcatgcccaagtgtctaggcagaaactgcatcctgttgttctaaagaagtagacccaagtttccatagcaagtggttagcagggtcctgaccacttctccttgttctggcacctcctgcaagctcctgggctctctccttgcttgaaatgggcaactgcccttgaaactcctccaagccccaatgggctgcccattgtccctgtgttcccaggatcaagcgcatggcaggcatgaaggaatcgcagatcagcgcagagattgagcttctgcctaccaacgacaagaagaaatgggctcgaccccccatttccatgaactttgagggtatggcagaggaggggcctagagtcatgccagggtatgctggaagacctcttagagatcattccgataaaccgctgcaccttagaggtgaggaaactgaggcctagaaagaagaactggctttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60364 - DNA, 1264 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttgctttgggatagtgtgagcttcattttgtacacgtgtgacttcgtccagttacaaacccaataaactctgtagagtgga

SEQ ID NO: 60365 - DNA, 1096 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaatcgaggtgagtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60366 - DNA, 1066 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatggccactgcggccaatgtagcgcacccatttgatgcgg

SEQ ID NO: 60367 - DNA, 1101 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatggcccagtccgcagttggtaaaatgaatcagtagccagcctcgcgctatgcttctagtacatcgccgctgctg

SEQ ID NO: 60368 - DNA, 1048 bp, Homo sapiens
  misc_feature (20)..(20): n is a, c, g, or t
  misc_feature (945)..(945): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgagcaggntcaagaagcatcctgagttcttgcctcctccttttggggacacccaaaacactgcttgtgagaaggaagatggaaggtaagttctgtcgttctttccccaaat

SEQ ID NO: 60369 - DNA, 1049 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggccaggggaggagaatggagggagtcaggaggctggggaagagaggggaggcacccctaccagacacagacagatgcagctgcaccatggtcacagggctgctggccacgtgtagctggcctggagaaagcgcaggtgg

SEQ ID NO: 60370 - DNA, 1688 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagtgagtctttccttcattaggccacagcagggctcaagatcccagtataccctcttgttttcagctttgatccttctgaatgaggggcaggggagtgtgcctgtttgcttttctaggagcctctgcttgtactgtcagtctttatacctccatgtgagtatgtacacgcctgcatttgggttcatgcacgtgcttattttttaagatgctttggcatttccctttgtaatgtatacattacaaagggaatacattgcctttgtaatgtatctgtgaagcagacaaagcaaacgatagcatgcccaagtgtctaggcagaaactgcatcctgttgttctaaagaagtagacccaagtttccatagcaagtggttagcagggtcctgaccacttctccttgttctggcacctcctgcaagctcctgggctctctccttgcttgaaatgggcaactgcccttgaaactcctccaagccccaatgggctgcccattgtccctgtgttcccaggatcaagcgcatggcaggcatgaaggaatcgcagatcagcgcagagattgagcttctgcctaccaacgacaagaagaaatgggctcgaccccccatttccatgaactttgagggtatggcagaggaggggcctagagtcatgccagggtatgctggaagacctcttagagatcattccgataaaccgctgcaccttagaggtgaggaaactgaggcctagaaagaagaactggctttaattcatagatccattcttcccctttcaagcctcttagtagaaattactatttgtgatgaggcaaatcttttacttctctcggcgtctaccttgtctttctgggataacacggtc

SEQ ID NO: 60371 - DNA, 1014 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgagtcgaggtgatcccaacccatgaacacagcggggtgcggtgatctgctgaggggaggccagttacagcagcgagatgcatcggtgggagatcaagcgctgcagctgagatcgaaacaggcaagagggttgctacaagaagagaaagggtcaccccttcggatgggggctcgcctggcaagggctgagggggcagggcacggccaggttcaacgggcggggcaacacgggagggaccccccacgggggccacaactggcaccgagagctggcagcagggcacggaa

SEQ ID NO: 60372 - DNA, 806 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgagtcgaggtgatccccaccccactgacacacgcggggagtgccgatgatagcgagggacctctagaacagccacccac

SEQ ID NO: 60373 - DNA, 862 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgagctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60374 - DNA, 883 bp, Homo sapiens
  misc_feature (20)..(20): n is a, c, g, or t
  misc_feature (829)..(829): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgagatcgcacaaccaaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctgcagcagtcaccaagcagaatgtcaacgctgccatgntcttcgaattcctctataagatgtgtgacgtgatgcgcctactaagcgatcagc

SEQ ID NO: 60375 - DNA, 336 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcagaggatgtgcggaagttttactggttaatgaaaagtagcctgaatggag

SEQ ID NO: 60376 - DNA, 677 bp, Homo sapiens
ctagagaccctcctatcatcggcacctcgctatcatcggcaccccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60377 - DNA, 864 bp, Homo sapiens
  misc_feature (817)..(819): n is a, c, g, or t
  misc_feature (827)..(827): n is a, c, g, or t
  misc_feature (832)..(833): n is a, c, g, or t
  misc_feature (844)..(844): n is a, c, g, or t
  misc_feature (848)..(848): n is a, c, g, or t
  misc_feature (850)..(851): n is a, c, g, or t
  misc_feature (861)..(861): n is a, c, g, or t
gacccacgcgtccggacccacgcgtccgggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggaaaaaaaaaaaaaaaaaaaaaaaaaaaaaaaaaaaaaaaaaaaaaaaaaaaaagggggggcgcnnnaaaaaatnccccnnggggggccccntagngnncccgtttttntga

SEQ ID NO: 60378 - DNA, 1660 bp, Homo sapiens
  misc_feature (20)..(20): n is a, c, g, or t
  misc_feature (1613)..(1615): n is a, c, g, or t
  misc_feature (1623)..(1623): n is a, c, g, or t
  misc_feature (1628)..(1629): n is a, c, g, or t
  misc_feature (1640)..(1640): n is a, c, g, or t
  misc_feature (1644)..(1644): n is a, c, g, or t
  misc_feature (1646)..(1647): n is a, c, g, or t
  misc_feature (1657)..(1657): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggaaaaaaaaaaaaaaaaaaaaaaaaaaaaaaaaaaaaaaaaaaaaaaaaaaaaagggggggcgcnnnaaaaaatnccccnnggggggccccntagngnncccgtttttntga

SEQ ID NO: 60379 - DNA, 1502 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctggactgcgcgtcacaggggatcctctcagat

SEQ ID NO: 60380 - DNA, 1559 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgagtcgaggtgagtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60381 - DNA, 1523 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60382 - DNA, 1680 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggagttgctggcttagtgttgatgtgggagctacatggggagggaactggtgttgctctccgtgcagttttctgtactgaatactctaaaggctctttccttgtcttgtcccagttaggcccctcctgggccatccaagcccttatccttgtgggttctgggcccaggtttcctggctcctcttagaaagcctc

SEQ ID NO: 60383 - DNA, 1306 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccagacgcatgcatacctgggcgtatgcctaaccgctaacattactgcaggccacctactcatgcacctaattggaagcgccaccctagcaatatcaaccattaaccttccctctacacttatcatcttcacaattctaattctactgactatcctagaaatcgctgtcgcctaatctgcag

SEQ ID NO: 60384 - DNA, 1257 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatggtgcccatggcaagttgcccaacttcccagccacccttctccacagggtcaagtcgcggttccttcccaaccacacatcagcggctccttccttctgctttggtggctttccttttgaccaagccccggctaggcttcggcccagcacctttcccagtcggaacccgtcgacgcagcccctaggcgtccttggcaagggaaagcttatgcgtcctgttttcccactcc

SEQ ID NO: 60385 - DNA, 1843 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgagggtatggcagaggaggggcctagagtcatgccagggtatgctggaagacctcttagagatcattccgataaaccgctgcaccttagaggtgaggaaactgaggcctagaaagaagaactggctttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccagtcagaactcccctgcccagggagcccaggggctgctccaccggtcccacttgtaatgtgcttggcccagacctagactcgggctggtgcaaagggaaggca

SEQ ID NO: 60386 - DNA, 984 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggccattcgcgccctctggccttgtacttggccttccccttcatg

SEQ ID NO: 60387 - DNA, 1091 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgccgctccctcccccaccacacatcagtgtctcctccctcctgctttgctgccttcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 60388 - DNA, 911 bp, Homo sapiens
  misc_feature (20)..(20): n is a, c, g, or t
ctaggtcgagcctcggtgantcggacgagtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgagatcgcacaaccaaggacatcatccttcccttcccaacctctcctaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttcca

SEQ ID NO: 60389 - DNA, 884 bp, Homo sapiens
gaagaggaaccgcgccatatgacccagatgataactatttacataattgttaaatacacagctgactcataaacatgtcttacaaagagatcaataacaggaagtaaacactattttaatatgactttgagggtgggtttgattctttttttcttggcatatcctaaataactccctctgtttcttcctgttaggatttaatatacacaagagaaaggtttcaggacttctaaattatgcagtagcaatgtcatttaactagcacttacaaattactgccacatctgcaggtcacctgtactgttatgtaattaccatttttctttagtcaactttaattcaacttacttataaaacttacccttcttctaagcaatggcagtgatgaaaattgggtttggtgtgctaattctattttactccagtactcactaaaagaaatacatgcttgttcaaataaaaaaaaacaaactttgtatttgtgttctgtgtaaaaccatctgcttatctagggtgacatctatcccaccatacaaaacactgtacaggtatctcagcttgttgagtattccaaaccaatccttctcatcattttcaaaatgtaaaattgcaaataagctttttgatatggtttgggtctcatgttgaattgtaatcctccagtgtcggaagaggggcctggtgggaggcgattaaatcatgggggtggatttcccccttgctgttctcataatagtgagtgagctttcacatgatctggttgtttataaaagtgcgtaacgccttcccgctctttctcttcctcctgctccagccatgtaaaacgtgcctcctgcctcttcaccttccgccacgattttaagtttcctgaaacctccccagcc

SEQ ID NO: 60390 - DNA, 874 bp, Homo sapiens
ctgggactttggtggtgctacccttggcctcccagagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcagtttgcagggacctggctccttgtggctgtgggctccgcttgccgtttcctgcaggagcagggccaccgggccgaggccaccacactgcatgtggctccccagggcacagccatggctgtcagtaccttccgaaagctggatgggatctgctggcaggtgcgccagctctatggagacacaggggtcctcggccgcttcctgcttcaagcccgaggcgcccgaggggctgtgcacgtggttgtcgctgagaccgactaccagagtttcgctgtcctgtacctggagcgggcggggcagctgtcagtgaagctctacgcccgctcgctccctgtgagcgactcggtcctgagtgggtttgagcagcgggtccaggaggcccacctgactgaggaccagatcttctacttccccaagtacggcttctgcgaggctgcagaccagttccacgtcctggacgaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagaccccaaaaaaactct

SEQ ID NO: 60391 - DNA, 743 bp, Homo sapiens
ccagcccgaggcgcccgaggggctgtgcacgtggttgtcgctgagaccgactaccagagtttcgctgtcctgtacctggagcgggcggggcagctgtcagtgaagctctacggtatgtgggggccagcctctgtgaccaggcaggcgctcaagctctgcacactcactgggccaccccgaggggctgggtgagcccatggggacacacttcctttctcccatcctgatcctcctgctaagcaggggcccagggagtagtgacagacaggcctggtgtgggagcagggagagggccccgagggggcaggggacacacagaccccgttcccagagccctccacgccgcctggtgccaggaccccaggaaccctgtctgccctgcagcccgctcgctccctgtgagcgactcggtcctgagtgggtttgagcagcgggtccaggaggcccacctgactgaggaccagatcttctacttccccaagtacggcttctgcgaggctgcagaccagttccacgtcctggacgaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagaccccaaaaaaactct

SEQ ID NO: 60392 - DNA, 821 bp, Homo sapiens
ccagcccgaggcgcccgaggggctgtgcacgtggttgtcgctgagaccgactaccagagtttcgctgtcctgtacctggagcgggcggggcagctgtcagtgaagctctacggtatgtgggggccagcctctgtgaccaggcaggcgctcaagctctgcacactcactgggccaccccgaggggctgggtgagcccatggggacacacttcctttctcccatcctgatcctcctgctaagcaggggcccagggagtagtgacagacaggcctggtgtgggagcagggagagggccccgagggggcaggggacacacagaccccgttcccagagccctccacgccgcctggtgccaggaccccaggaaccctgtctgccctgcagcccgctcgctccctgtgagcgactcggtcctgagtgggtttgagcagcgggtccaggaggcccacctgactgaggaccagatcttctacttccccaagtacggcttctgcgaggctgcagaccagttccacgtcctggacggtgagtgcacagcggggcaagcatggcggcgtggtgaggggggccactgccaccggctgagtctcgtctctgctgcagaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagaccccaaaaaaactct

SEQ ID NO: 60393 - DNA, 902 bp, Homo sapiens
ctgggactttggtggtgctacccttggcctcccagagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcagtttgcagggacctggctccttgtggctgtgggctccgcttgccgtttcctgcaggagcagggccaccgggccgaggccaccacactgcatgtggctccccagggcacagccatggctgtcagtaccttccgaaagctggatgggatctgctggcaggtgcgccagctctatggagacacaggggtcctcggccgcttcctgcttcaagcccgaggcgcccgaggggctgtgcacgtggttgtcgctgagaccgactaccagagtttcgctgtcctgtacctggagcgggcggggcagctgtcagtgaagctctacggaccccaggaaccctgtctgccctgcagcccgctcgctccctgtgagcgactcggtcctgagtgggtttgagcagcgggtccaggaggcccacctgactgaggaccagatcttctacttccccaagtacggcttctgcgaggctgcagaccagttccacgtcctggacgaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcagaccccaaaaaaactct

SEQ ID NO: 60394 - DNA, 775 bp, Homo sapiens
cccaccccggctgtggcctggactaggattcctggttggggtctcccagcctgtggtgcctcctccccgcccccccagggatgggatctgctggcaggtgcgccagctctatggagacacaggggtcctcggccgcttcctgcttcaaggtgaggcaggggctgcagggcatgtgggtgggggatgacgcagccactgtggctctctgacatggctactgtggctctgccccagcccgaggcgcccgaggggctgtgcacgtggttgtcgctgagaccgactaccagagtttcgctgtcctgtacctggagcgggcggggcagctgtcagtgaagctctacggtatgtgggggccagcctctgtgaccaggcaggcgctcaagctctgcacactcactgggccaccccgaggggctgggtgagcccatggggacacacttcctttctcccatcctgatcctcctgctaagcaggggcccagggagtagtgacagacaggcctggtgtgggagcagggagagggccccgagggggcaggggacacacagaccccgttcccagagccctccacgccgcctggtgccaggaccccaggaaccctgtctgccctgcagcccgctcgctccctgtgagcgactcggtcctgagtgggtttgagcagcgggtccaggaggcccacctgactgaggaccagatcttctacttccccaagtacggtgagtgtccccagcaggtccccagctcagccacccccactctctgggctgatgtccag

SEQ ID NO: 60395 - DNA, 279 bp, Homo sapiens
ccaggatcagaccctgggctcactgcctaggtgagaaactcccagagtgatgatgcgtcctgattcatgtggcacatagggtccatctgtcccattggtggtggtggtggtaacattgatcacttggtcaagatgatgtttgccagcttttctgtatacaaagttgtttttgactaggtagtggctcatgcctatagtcccaacagaggctgaagcaggaggatcacttgaggccaggtgtttgagaccagcctgggcaacatagcaagaccccatctc

SEQ ID NO: 60396 - DNA, 318 bp, Homo sapiens
agcagctctagctgcagaagcaaggatttggcatgcatttcaattctccgatatctaaaggcaaccacaaaaggttctgagattcttctggacctgacatctggagcccagagcccgggatttgccagcgtcattgtctgtctctcaagttcacccaccactcacataactggcatagctaggtacaaagaaccaactgagggggagacttggtattttccagaattcaggaaattgaattatccacataggaaatatcacagagtaaacaatccaactgctttttttaattaaaatattctgaaataaagattaggc

SEQ ID NO: 60397 - DNA, 384 bp, Homo sapiens
ataaatattgcctaactttgttctattaccaaacttgtggcaactttactgtgacgagatttgaggagaaagataaaatttaatacccaattgaaaatagatggttaaacaaacaagcaaaaattattattattatttcattattttttgagacacgatctctctgtatcatccaggctggagtgcagtggtgcaatcatggctcactgcagcctcaaactcccaggctcaggtgatcctcccacttcagcctcccaagtaactgggcctagagacatgcactaacacacctggctaatttttgtatattttgaagagacagggtttcaccatgttccccatggctagtcttgaactcctaagctcaagcgatccacccgcctc

SEQ ID NO: 60398 - DNA, 496 bp, Homo sapiens
tcccgccccaccagttaccctgtgacccagcaccgtgaagaagccgagcctccatccccaatctgagcatgctatctggcctcgcctttgattggcagggcccacgctgctgcttctccctcaccccactgctctgcaggaaaaaagtgcaacgttctgctgcttacagcccctcggccttggaaagcgcggttcctctccacgtggatcaccaaatgccagtccagagccatttgcctaggggtgtccctgcgggccttgcaggtcaccacatgaaacacgcaggagcaactcacaggccagcgatggaagttgagttactattttgtggggccaaccagaatgtcaatttttttggatgctgggtagatagaatgaggtatagtaaaccaagggtctaacacagtgcctggccccaggtaggtgcaaaatgcatgcttgtttctgtttcttatctttatgtgcacccaccccagttctttgctctctctttcct

SEQ ID NO: 60399 - DNA, 457 bp, Homo sapiens
  misc_feature (448)..(448): n is a, c, g, or t
  misc_feature (451)..(451): n is a, c, g, or t
tgcaacattgaatcagataaagtcaaaaattttcattactcttttctcatagggactgttatcttgtggagcctgggcttgctttgatgagtttaacagaattgatttggaagtactctctgtggttgctcaacaaatccttactatccaaagaggtattaatgcaggtgctgatatactgatgtttgaaggaactgaactaaaacttgaccccacatgtgctgtctttataacaatgaaccctgggtatgctgggcgatcagaactgccagataacctgaaggctctctttcggacagtagcaatgatggtacctgactatgccatgattgctgaaatagtcctatactcctgtgggtttgtcactgctcgaccactgtctgtaaaaattgtggctacgtatcgcttgtgttcagagcagctgtcatctcaacatcactacgactanggntgagag

SEQ ID NO: 60400 - DNA, 642 bp, Homo sapiens
  misc_feature (3)..(3): n is a, c, g, or t
  misc_feature (6)..(6): n is a, c, g, or t
  misc_feature (8)..(9): n is a, c, g, or t
  misc_feature (12)..(12): n is a, c, g, or t
  misc_feature (633)..(633): n is a, c, g, or t
  misc_feature (636)..(636): n is a, c, g, or t
tanggntnngantatctgggtaattcccctaggctggttattacaccactcacggatagatgttacagaaccttatttggagcccttcatttgcaccttggaggagcacctgagggtccagctggcactgggaagactgaaactaccaaggatttggcaaaagctgtagccaaacaatgtgttgttttcaactgctctgatgggttggattatttggctttgggaaaattctttaagggactgttatcttgtggagcctgggcttgctttgatgagtttaacagaattgatttggaagtactctctgtggttgctcaacaaatccttactatccaaagaggtattaatgcaggtgctgatatactgatgtttgaaggaactgaactaaaacttgaccccacatgtgctgtctttataacaatgaaccctgggtatgctgggcgatcagaactgccagataacctgaaggctctctttcggacagtagcaatgatggtacctgactatgccatgattgctgaaatagtcctatactcctgtgggtttgtcactgctcgaccactgtctgtaaaaattgtggctacgtatcgcttgtgttcagagcagctgtcatctcaacatcactacgactanggntgagag

SEQ ID NO: 60401 - DNA, 278 bp, Homo sapiens
agtcagacaaccctgtgctcaaatctgccaccgcttgctgtgaccttggacaagttacttatcttccatatgcctcaatttcctccgctgtaaaatggcaatagtaactgtattctcaaggttgttgtgaagatccaaagagctaatatatgtagtgcttacacctgcctgcagcatggtaggtgctttgtaaagtttagtgattactgtccctgcattccctgcaaaaactagcacctgtcagatgctcaataaatatatatacaaattatccataa

SEQ ID NO: 60402 - DNA, 300 bp, Homo sapiens
gctattattatcatcagtagcattactcttctgaaggatggacatttatgaatgttcgaataactcattcatcttgtaacagtcacaccatcctcatatgtaatattctccttacaaatagttttatctaagtttaaatccataaatagatcattttgttttttgaagctcttacctaccacaaaattttgacttattacaaaatctcaaaatgaattttgacactagcctttttacacttatatatatgagcagcattaattgggtgtctaaattgtgtatttttttaagaaacagtga

SEQ ID NO: 60403 - DNA, 165 bp, Homo sapiens
  misc_feature (156)..(156): n is a, c, g, or t
  misc_feature (159)..(162): n is a, c, g, or t
  misc_feature (164)..(164): n is a, c, g, or t
ttgatttgaaacccaatctttttgactctgaaacatcttccttgtcacaggtggagatggagtgggtgaaacaatatgcaatctcttattatccccttttattaccagcatcttcattcagtgagtatattccaaggacagccctggcgtggtccntannnnana

SEQ ID NO: 60404 - DNA, 481 bp, Homo sapiens
attttcattttaaacaaagtcattgagggtaattgaataagctccagcaatatgtgggtgtgaaatagcagttgcttagtcgcacaaagaaaagcaggtttttattacaactttgatgtgtcgtggatgaagaatagaggcctgcactttttccaaaccccgtagttcctcagagagcattctgtgggcaaaggaactgctaatggaggctcgattgtttttcaaccactggtggtggagatttcagctttttgtgtgtaatttgtcccagtccattttctccaaggaaaagaatgtcttgtcagttttctcaaatagaattggatttcctttttagtctgtgaagagaatcaggtcaagtagttaaaccaaagactgtcaagggtaggcatttgagtttttccatctgtgctgtaatacttttggagtccttgtgtttctaaggagtttggcatgctttgttctgtggttcgtagaaagt

SEQ ID NO: 60405 - DNA, 874 bp, Homo sapiens
caaaggggcagctacatgccacaacttttcctgcaaggcctacagagacagagctataggaaggcctctggctctgccttggaccagacaattcctggacagagacctgtttgaagggaaggtctgaataagcttacctgttttgctgctgctgaggccaaatcactctgcttcaaatacgaaggggcagctacattccacgacttttcctgcaaggcctacacagacaaatcaggagggaacagaataccgacgtcacaaagactggcatatcatttggaatttacatttttgttttcctttgaaagtctaccatgaacaggacttctcaattaatcttattcttttaacccaataagctgtatctattatggagaaagatgagactaatggtttgggctaaatgaattcccatccatttgatccaattcttggcccaaaggctctgtgtcccagatcagtgcttctggaagcagaggacaggaaccatgaaaccttcaccagaatgcgcaggcaagccagcttccgggctctaggcactccttgttcccagagccactggactaacccaagccacctagatacttcttccttgactgtggttcttttttcttttcccctatgctcattatgttataagccccaaccactttaccaacatattcaactagaaatcaagcagctttcctagatttctccctctttcaatcttctacattcaaaaccaccactaagagccacgattttaccttccatctctctcctcacctatccatccacatgacctcatctcttgcacaaacttctgtgacagcctcttattttctcagtccttctgaattacagatgtaatcaaatgacattacagaaaacc

SEQ ID NO: 60406 - DNA, 375 bp, Homo sapiens
cctgggagatagaggctacagtaagccgtgtttgtgccacagcattccagcctgagtgacggaaccacactctgcctcaaaaataattttgtaaagagtcacagcctacaaggtggcaatcctgatagctgggaagcatcctcccgcagagcacagaaacagaccttcaagggaggatagaacagggatttatgctgaacgggttggccaagtttatatatttaacaggttataggaggagctatgaatattcacaaagtgggggaggtcatgcacatgcaggctgaataaacatgtatgttacatacttatccatattcacttgtgggtggagacttaacatctaaaaggattacaatgaggccctgtagtcag

SEQ ID NO: 60407 - DNA, 509 bp, Homo sapiens
gcttgaggtcacacattaatgggcaactgaaccagccttgatgctgaaagatcctaatttccagtctagaaatctctccagaaagaaatctctctctgttctgcaaggtactttgtgcttatatgtgtgttgggtccccgcagacctgaaccagaatgtgggtagaattcacccctggcaaaaagagctcctctcttgtaaccacggacttaaccagtctttatctagaatggaatccccttttctagagattgtaggtacctagggtcactgttacctcacaaagggtggaaaaaagaggggaaaaggccctgggctcagaaacacccctgttctcatccctgcgctggcccttgataagctttgtggccttgggcaaatcatgagagctgtctaaactctctgagaaatgtggacgggcacaaccactttgtcgggaagctgaaagcattagcaatgacacgtcgtaggcatcaaggaggcgttcaataaatggtagtttaaaaaca

SEQ ID NO: 60408 - DNA, 2137 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60409 - DNA, 2091 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60410 - DNA, 2100 bp, Homo sapiens
ccaggctggtacgccccgagttacgggatgaaggacgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60411 - DNA, 2343 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccaggtgagtgccgggcccccctgccctccactccagcccacaccagcacccagggctgcactaacctcgccctttctgcccgacacgctgccctgccggggagggaccaagttctcagcctcagggtgctttcctgaagtcctgccccgagccccaacccaaccctgaggagggggccctctggagctcgggtgcccccggccccgcagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60412 - DNA, 2228 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagcctcagggtgctttcctgaagtcctgccccgagccccaacccaaccctgaggagggggccctctggagctcgggtgcccccggccccgcagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60413 - DNA, 1685 bp, Homo sapiens
aaattagcttaggtcgagcccgggtggtaaatcggcgaggcgccatatttgccctctgggatcatcatggactccagcatctcgaagcaggctctgagcgagattgagacgcggcacagtgagatcatcaagctggagaacagcatccgtgagctacacgacatgttcatggacatggccatgctcgtggagagccagcctcagggtgctttcctgaagtcctgccccgagccccaacccaaccctgaggagggggccctctggagctcgggtgcccccggccccgcagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60414 - DNA, 1676 bp, Homo sapiens
gatagctaggtacgaggccgggtatcggccgaggcgcatctttgctctgggatcatcatggactccagcatctcgaagcaggctctgagcgagattgagacgcggcacagtgagatcatcaagctggagaacagcatccgtgagctacacgacatgttcatggacatggccatgctcgtggagagccagcctcagggtgctttcctgaagtcctgccccgagccccaacccaaccctgaggagggggccctctggagctcgggtgcccccggccccgcagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60415 - DNA, 1972 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtactcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60416 - DNA, 1260 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccaggtgagtgccgggcccccctgccctccactccagcccacaccagcacccagggctgcactaacctcgccctttctgcccgacacgctgccctgccggggagggaccaagttctcagcctcagggtgctttcctgaagtcctgccccgagccccaacccaaccctgaggagggggccctctggagctcgggtgcccccggccccgcagggagagatgattgacaggatcgagtacaatgtggaacacgcggtagactatgtggagagggccgtgtctgacaccaagaaggccgtcaagtaccagagcaaggcgcgccggaaggaacagtcatgatcatacatctgctgtgtgatccatgggcaatcgacaatcgcactccaacatgtaggagggacatcataacagacatagaaagacgcacaccacaactgacacatccaactccagagtgaggcacaatcacaaaggaacgaaccatgacatgatgcacaacatggcatgcgacagcacaacacaaaaa

SEQ ID NO: 60417 - DNA, 588 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagtgagtcaggcttgtctgggggtgggtggggggcattctaggcctgcttcctctgcggatcccatggggttttgctcgccctgagggggtgcgccggatcttgctttcctttctgagggtggcgtcatgtgcccattcactcagcagctacttggcaaggcccgttggtgccagactctggatgggcactgcccctcacctctgctaaagagggttgaagaagtggccagtacttcctggtc

SEQ ID NO: 60418 - DNA, 876 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtaatctgtaaaaaaaaaa

SEQ ID NO: 60419 - DNA, 1053 bp, Homo sapiens
ggcggccgtcgcgcatgcggggctcacacggctgcagccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacaggtgcggccacggagtctaggatgggcgggcacctgagtctctgggtcggtccccgcagggcctgacccctgcacctccatctcgggcccccagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagcctcagggtgctttcctgaagtcctgccccgagccccaacccaaccctgaggagggggccctctggagctcgggtgcccccggccccgcagggagagatgattgacaggatcgagtacaatgtggaacacgcggtagactatgtggagagggccgtgtctgacaccaagaaggccgtcaagtaccagagcaaggcgcgccgggtcagtagcccagccct

SEQ ID NO: 60420 - DNA, 417 bp, Homo sapiens
taaagaagacagcaaacaaagttcgttccaagttaaagagtgagtcaggcttgtctgggggtgggtggggggcattctaggcctgcttcctctgcggatcccatggggttttgctcgccctgagggggtgcgccggatcttgctttcctttctgagggtggcgtcatgtgcccattcactcagcagctacttggcaaggcccgttggtgccagacctgggctgggcccagggacacacccacctaaggctttggcgagggagggctccactctggatgggcactgcccctcacctctgctaaagagggttgaagaagtggccagtacttcctggtctcttgcagaagcccggtattctgggtgaacagacacgtgcaccccatgagtgccaaggcctcggggccacatgccctgcag

SEQ ID NO: 60421 - DNA, 304 bp, Homo sapiens
aggggagatgaagattcttggcagctgtgacagcgtgcaaggagggtcttgaagaattagcagcaaggagagtagcaagcacaggctgaggaggtgcctgggactcaaatgatagggattttaaggaataataatcatgacacaatttatgccacacgcctcagccctcaccactgcagtgcaccctagaagcccagaaagagcctgtccagatgcagggcaggctgaaactgctggggagctaactcccccaaaacattccccagcagcagcctggcttccttacatctcaggtagggcagct

SEQ ID NO: 60422 - DNA, 361 bp, Homo sapiens
ttgaatctgtatagaccaaattggggagtattgtcatctcagcaatattaaggcttccagtctgtgaccatgaagataccttactgaagtcttctttacttaaaccatttatttaggtctttaatttctttcagtggtttatagttagttattagtatacaaatcttaaacttattttgtttttaagtgttttattctaaatacaattctaagtattttattcttttcgatggtattataaatgaatgtatgttttcttagcttaacttttgggttgtttattgctagtgtatagagatatgattggtgacgaggcatggtggctcatgcctgtatttcccacacgttaggaggctgaggt

SEQ ID NO: 60423 - DNA, 242 bp, Homo sapiens
ggaataagttagaaaagtttatttaataaacataattaaacagattctctaaactagaaataacattcagtttcaggaaaccagaattagacccctccaagacctttgagaatatctaattcacctatgtattataaacaagaaaaatgaaacagagagataacacactctgcccactcccttttcaaaatcatgtgagtgatagtaacagactccttgaggcaagattattactgtaatag

SEQ ID NO: 60424 - DNA, 470 bp, Homo sapiens
cagatcccatttttctatggcttgcttggttcaagctatcaccatcatcatcaatatcattatcatttttgccctaagactgagatgtccctgtaagtcaacctgtcaggatgagctgtatgtgaacattcaaatttagaaggcagttgtctttgaaaacagcttctattagggtgtaagtaaaacaacatgggctgggtgtggtggctcacgcctgtaataccagcactttggaaggccaaggcgggaggatcacccgaggtcaggagtttgagacgagcctggccaacagggtgaaaccccgtctctactaaaaatacaaaaattagcaaggcatggtggcctgtgcctgtaatcccagctacttgggagactgaggcaagagaatcacttgaacccaggggtcggaggttgcagtgagctgagatcatgccagcgcactcctgcctgggtgacaagagcaagacttt

SEQ ID NO: 60425 - DNA, 325 bp, Homo sapiens
gccacaggcaccataggctgcgggttggacaagcttggtttataggcctcatatgtggtggggctgctgttttaaaagtctcatcagtgcagattttacttattgcatgaagattggtatttaagttgagatgaagggtagtatattttgtttgagatcattacacttgtgaagagttaattgagttgcatgtttttcacgtattatttagtcatacctttatcatgacaggatgattctgcttcacaacttctttctgtttttaaggaaaggggctgggcatggtggttcaaccctataatcccagcacttttggaggcggaga

SEQ ID NO: 60426 - DNA, 2184 bp, Homo sapiens
ctctaaagcaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggacttggccgccaccctgcgacggagcggcgcccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcttcccgcagcatcccacccccaaaccaccgactctcattgccgacactgcagcagaatctctccgggtgggagcccaattattcattctccctttattgattcatcgaggagaacttggtagatggggagaaaaacacagttggtttttttttccacgttatcaaccgtgactgcaagagcgttcgtgcatgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtg

SEQ ID NO: 60427 - DNA, 907 bp, Homo sapiens
cgcggaggcccgtcggttcggtccgctctgggcgttagcaagtgatctccagccaaggcggccgccaccccttgcacacagcagaaaatgcaaaatgaccctctggggcagtgaggggctgtggccctcggccccggcctgccgcacccccttcccgcagctggcggccggcagcgccgaacagggtccgggtgcagccctctcccgcccctccgctgaggcgccggcctgaactgggcgcgggaaccaggccgccctcggcgcccagcccgccctagtcccgcgcgccgcccccgctgtgccgcgcccacatgggtctgtgctacagtctgcggccgctgcttttcgggggcccagggacgacccctgcgcggcctcggagccgccggtggaggacgcgcagcccgccccggccccggccctggccccagtccgggcggccgcaagggacacggcccggaccctgctccctcggggcggcgaagggagcccggcatgcgctcggcccaaagcagacaagccgaaggagaagcggcagcgcaccgagcagctgagtgccgaggagcgcgaggcggccaaggagcgcgaggcggtcaaggaggcgaggaaagtgagccggggcatcgaccgcatgctgcgcgaccagaagcgcgacctgcagcagacgcaccggctcctgctgctcggtacttcgggagcatctagagggcgtgatttggagtctgctagccaggaggccacaggagaaacacaggtcagccccagaatcatggagcacacatttgcctcgaccccagctgtattttcttttctgggaaaatatcagcccctggaattaggccagacacaggaatctgtagatacaaagctcgctagcagagcaagactcagaacgcaagagtggcac

SEQ ID NO: 60428 - DNA, 2470 bp, Homo sapiens
cgcggaggcccgtcggttcggtccgctctgggcgttagcaagtgatctccagccaaggcggccgccaccccttgcacacagcagaaaatgcaaaatgaccctctggggcagtgaggggctgtggccctcggccccggcctgccgcacccccttcccgcagctggcggccggcagcgccgaacagggtccgggtgcagccctctcccgcccctccgctgaggcgccggcctgaactgggcgcgggaaccaggccgccctcggcgcccagcccgccctagtcccgcgcgccgcccccgctgtgccgcgcccacatgggtctgtgctacagtctgcggccgctgcttttcgggggcccagggacgacccctgcgcggcctcggagccgccggtggaggacgcgcagcccgccccggccccggccctggccccagtccgggcggccgcaagggacacggcccggaccctgctccctcggggcggcgaagggagcccggcatgcgctcggcccaaagcagacaagccgaaggagaagcggcagcgcaccgagcagctgagtgccgaggagcgcgaggcggccaaggagcgcgaggcggtcaaggaggcgaggaaagtgagccggggcatcgaccgcatgctgcgcgaccagaagcgcgacctgcagcagacgcaccggctcctgctgctcggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggacttggccgccaccctgcgacggagcggcgcccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcttcccgcagcatcccacccccaaaccaccgactctcattgccgacactgcagcagaatctctccgggtgggagcccaattattcattctccctttattgattcatcgaggagaacttggtagatggggagaaaaacacagttggtttttttttccacgttatcaaccgtgactgcaagagcgttcgtgcatgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtg

SEQ ID NO: 60429 - DNA, 316 bp, Homo sapiens
atttctgcatttggtctgtgtgactctatggagcccaggacttacagaaaaggtgtaacctggctcttaggactttaagccacattatggtagtagacctgccgttttatttgacatggtgaaataaactaccactcctttgtggtaccatatgggcaggacagagctcttcaaccctggctaacaagcctgaagaagaccctgtgaggccgcagcagccatgggaacttcccaaaggacagaaatccacatgctaacgtagcatccagataggtgacagaaattccttccaccatatccaaatgtgtcctgtttt

SEQ ID NO: 60430 - DNA, 1393 bp, Homo sapiens
  misc_feature (1351)..(1351): n is a, c, g, or t
gggttatgtggctcttttgattatccccagctctacctgcaaggagcactgggaaatatatctttgggcccctcaattaggtgatgtgactcccctttctggactctttcctcaggaggtattgtgacatattcctggagcaagtacccaggagagattgtgacatatctctggaaccagaaccttggtgatgtgactcttctctcctgctgaagccatgcccacacaagggaaagtgacttatcactgggcccagcacacagcgctattcacagggaaaatagtgacacatctgtggggttctcaccgaaatgatgtgactctcttgcctgggctcacctctcaagggaattttgacatattactggaccaagcacctaggccctgcatttattgtgtattgtgacatatggcttggtccaacacctaggtggtgtgactctctacttcttcctgtgccatgccaaagaagaggattgtgacatatcactggatccagcacctagaaggctctgcgactcttctattttctctaggttatgcaaatggaggtggattgtgacatatcatagggccaacacaacacacagtctacaggtggaattgggactctcatgcatggatccagttcatcattgatactgtgactcaggtgggattttgacatataactgcacccagcacacaggtgagattgtgactcttgtatgctcatcctgccaaaagttgagtgtcaccctcacacatggacagagacttctggagacagatggattttggagaatgacagtggattatcatgaggttaatcaagtggtaactccaattgcagctgctgtaccagatgtagtttcattgcttgagcaaattaccacatctcctggtacctgtggtccattacattgatgacattatgctgattgaatccagtaagcaagaaatagcaaacacaccagacttattcatgagacgtttgcatgccagaggatggaaaataagtctgactaaaatttagagaccttctagctcagtaaaacttccaggggtccagtggtccaaggcctgtcaagatagtccttctaaggtaaaagatgcagtggctcatgcctgtaatcccagcactttcggaggctgaggtgggcagatcaggaggttaggagttcgagaccagcctggccaacatggtgaaatgccatctctactaaaattttaaaaaattagctagacgtggtggcaggcacctgtaatctcagctacatgggaggttgaggcaggagaattgcttgaaactggaaggcaggggttgcagtgagctgagatcaggccactgcattccagcctggacaacaanagtaaaactccatctcaaaaaaatttgtttatatatatgttt

SEQ ID NO: 60431 - DNA, 971 bp, Homo sapiens
gtaattcttgtttcttaaattggctttgaccataggagggattgagacaattctggaagcccagcacctaggtgatgtgactttcatcttttgtttggaccgtgtgcacaaaaggaagagtggcttatcactggacctcacacacaggaggtattgtgacatattcctggagcaagtacccagtgattgtgacatatcatcaaacccagcaactagacgatgtgatttttcttccctgcttgagccctggatatgctgtgcattgtgatatatggctgggtccaacatcaaggagagattgtgacatatctctggaaccagaaccttggtgatgtgactcttctctcctgctgaagccatgcccacacaagggaaagtgacttatcactgggcccagcacacagcgctattcacagggaaaatagtgacacatctgtggggttctcaccgaaatgatgtgactctcttgcctgggctcacctctcaagggaattttgacatattactggaccaagcacctaggccctgcatttattgtgtattgtgacatatggcttggtccaacacctaggtggtgtgactctctacttcttcctgtgccatgccaaagaagaggattgtgacatatcactggatccagcacctaggtcttttcccacagggagcattgtgaaatatcactgggctcagcccccaggttatgtgacctttctgccttgccctgctcccaggaaatgttgtgacatccctcatacagcacccaggtgatgcgactcttctgctcattttctacttatacttgggattgtgacaaatatcctggtccaactcataggtgctatgatgattcccatacctggaatcagctaataggggagatagtgtctcttgtattgtagcttagggaaaaaagtaacatcttgggcctcctctttgtatgaatgtcataaagaattaccaatctgactggg

SEQ ID NO: 60432 - DNA, 2099 bp, Homo sapiens
ggcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagactcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaag

SEQ ID NO: 60433 - DNA, 2558 bp, Homo sapiens
ggcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagactcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagtttggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagc

SEQ ID NO: 60434 - DNA, 2504 bp, Homo sapiens
ggcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagactcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagtttggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagc

SEQ ID NO: 60435 - DNA, 2450 bp, Homo sapiens
ggcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggtgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagactcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagtttggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagc

SEQ ID NO: 60436 - DNA, 929 bp, Homo sapiens
  misc_feature (690)..(690): n is a, c, g, or t
  misc_feature (701)..(701): n is a, c, g, or t
  misc_feature (731)..(731): n is a, c, g, or t
  misc_feature (793)..(793): n is a, c, g, or t
tctcagtttaaaaaataagggtgtaaatacatctcaaaagtgtacagatttctcactgagtttgttttaacctttgggaaaccacaatagaccctgaagatatccataatttttacccagtaaattttttctttatttagatgatttgcagttttagtatttactgttgtaattagatggtaatcttaaaaatgcattgctaacttcaaaccatatttaaattatcagtagctatgtatatataatcacatggaggttgtagccttgccttgtatgattaaacagagaagaaaggtggtatttgttaacatttctgttttttacatgtatcattcttttatcacatctcataggtgatagcatcctatttttttctttattttcttgggattcagcccaagtctgtctccaaagtccatcttctttcctactgctctactacactgcagagaaataggacggtgaaactgaatatatatgtatgtactgtcataaaactggttataatgcgttctttttctccccccaatctaccttttctttttccccagaatccagattatcttcagtattctatcagtacagctctctgcagcttaaactcggtggtacataaagaagatgatgaacccaaaatgatggacactgtataatttggttaagactgctgaggccaagtgctattgtcangaaagagactngctattctgcacttatggtctgacttattngtaagaagtcattgtcgagactgcttggtctatgctactatgcatgaagtgattcatcttanacggttgagttcacttatgtcgcttaaatagaaacttcgcttcatggttaaaaatgactaagggggggaattattcccccgtaaaattccccaaattttcccgaaaaaggtttaaccctcgggaagaaattttttt

SEQ ID NO: 60437 - DNA, 1833 bp, Homo sapiens
ttttttttttgttttttctaggcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactcttaacatagtctgggatctctcagggagtaagttttaaaagaatactaatggcttgtaagaacaaacaggaataataatctgatttttaaatttgtggttattttactcatgttgccttttaatttttgttattttggtttattttttgatgtagccttttaaaaaaggagtcttaaaaatgatttttttttaaaggcaagagaaatcttgtagtgctaactgccttgagctgccaattacctatttctgagaatttggtgactcttattggtaatgatggcatttacaacatttggcatttcccctttttcagctcagttaccatagaatacttccaagctttactacttcctctgtaagtcatttcagttatgccaggatatttgatgattttgtttatgtagaattaggtaacaaagccaattatgctatccttattattgaaggattaatcttatgacttaacataagctttggttatatttgggtgtagtctttggctaagtacccattaaggctagtagcaaacacttggaaggtggctaactgggactgggaatacgtgtctcaacttgagaaaccaaatagtgcgaagggactcagggtggccagacctgtgaccttggcctcatttgtatcttgttttcgctgaggtgatcagacacttagtaccctagaaatggactggaattattgaatcttcttctgtaacatcacaatcttcctggttttcagaataaacgtttttgtgcttttgatataaatatatactctataataaaatgtttgactaatt

SEQ ID NO: 60438 - DNA, 2198 bp, Homo sapiens
tctcagtttaaaaaataagggtgtaaatacatctcaaaagtgtacagatttctcactgagtttgttttaacctttgggaaaccacaatagaccctgaagatatccataatttttacccagtaaattttttctttatttagatgatttgcagttttagtatttactgttgtaattagatggtaatcttaaaaatgcattgctaacttcaaaccatatttaaattatcagtagctatgtatatataatcacatggaggttgtagccttgccttgtatgattaaacagagaagaaaggtggtatttgttaacatttctgttttttacatgtatcattcttttatcacatctcataggtgatagcatcctatttttttctttattttcttgggattcagcccaagtctgtctccaaagtccatcttctttcctactgctctactacactgcagagaaataggacggtgaaactgaatatatatgtatgtactgtcataaaactggttataatgcgttctttttctccccccaatctaccttttctttttccccagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactcttaacatagtctgggatctctcagggagtaagttttaaaagaatactaatggcttgtaagaacaaacaggaataataatctgatttttaaatttgtggttattttactcatgttgccttttaatttttgttattttggtttattttttgatgtagccttttaaaaaaggagtcttaaaaatgatttttttttaaaggcaagagaaatcttgtagtgctaactgccttgagctgccaattacctatttctgagaatttggtgactcttattggtaatgatggcatttacaacatttggcatttcccctttttcagctcagttaccatagaatacttccaagctttactacttcctctgtaagtcatttcagttatgccaggatatttgatgattttgtttatgtagaattaggtaacaaagccaattatgctatccttattattgaaggattaatcttatgacttaacataagctttggttatatttgggtgtagtctttggctaagtacccattaaggctagtagcaaacacttggaaggtggctaactgggactgggaatacgtgtctcaacttgagaaaccaaatagtgcgaagggactcagggtggccagacctgtgaccttggcctcatttgtatcttgttttcgctgaggtgatcagacacttagtaccctagaaatggactggaattattgaatcttcttctgtaacatcacaatcttcctggttttcagaataaacgtttttgtgcttttgatataaatatatactctataataaaatgtttgactaatt

SEQ ID NO: 60439 - DNA, 2145 bp, Homo sapiens
tctcagtttaaaaaataagggtgtaaatacatctcaaaagtgtacagatttctcactgagtttgttttaacctttgggaaaccacaatagaccctgaagatatccataatttttacccagtaaattttttctttatttagatgatttgcagttttagtatttactgttgtaattagatggtaatcttaaaaatgcattgctaacttcaaaccatatttaaattatcagtagctatgtatatataatcacatggaggttgtagccttgccttgtatgattaaacagagaagaaaggtggtatttgttaacatttctgttttttacatgtatcattcttttatcacatctcataggtgatagcatcctatttttttctttattttcttgggattcagcccaagtctgtctccaaagtccatcttctttcctactgctctactacactgcagagaaataggacggtgaaactgaatatatatgtatgtactgtcataaaactggttataatgcgttctttttctccccccaatctaccttttctttttccccagaatccagattatcttcagtattctatcagtacagctctctgcagcttaaactcggtggtacataaagaagatgatgaacccttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactcttaacatagtctgggatctctcagggagtaagttttaaaagaatactaatggcttgtaagaacaaacaggaataataatctgatttttaaatttgtggttattttactcatgttgccttttaatttttgttattttggtttattttttgatgtagccttttaaaaaaggagtcttaaaaatgatttttttttaaaggcaagagaaatcttgtagtgctaactgccttgagctgccaattacctatttctgagaatttggtgactcttattggtaatgatggcatttacaacatttggcatttcccctttttcagctcagttaccatagaatacttccaagctttactacttcctctgtaagtcatttcagttatgccaggatatttgatgattttgtttatgtagaattaggtaacaaagccaattatgctatccttattattgaaggattaatcttatgacttaacataagctttggttatatttgggtgtagtctttggctaagtacccattaaggctagtagcaaacacttggaaggtggctaactgggactgggaatacgtgtctcaacttgagaaaccaaatagtgcgaagggactcagggtggccagacctgtgaccttggcctcatttgtatcttgttttcgctgaggtgatcagacacttagtaccctagaaatggactggaattattgaatcttcttctgtaacatcacaatcttcctggttttcagaataaacgtttttgtgcttttgatataaatatatactctataataaaatgtttgactaatt

SEQ ID NO: 60440 - DNA, 770 bp, Homo sapiens
ttttttttttgttttttctaggcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagta

SEQ ID NO: 60441 - DNA, 1900 bp, Homo sapiens
ttttttttttgttttttctaggcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgtactttactaaataagttggggggtacaatttttaaaagtcttaactcttaaatacttgactttcggcaccatcagttaaatccttgactataatacaaatttgatatatacattacatttaccctcaaattattctcaaaactatattccttagaatttgattttaccctgctgactttaagagttataataatatcaaatgtgatgagctaatatagattttctttttaaataagaataacttcaagctcactcttaacatagtctgggatctctcagggagtaagttttaaaagaatactaatggcttgtaagaacaaacaggaataataatctgatttttaaatttgtggttattttactcatgttgccttttaatttttgttattttggtttattttttgatgtagccttttaaaaaaggagtcttaaaaatgatttttttttaaaggcaagagaaatcttgtagtgctaactgccttgagctgccaattacctatttctgagaatttggtgactcttattggtaatgatggcatttacaacatttggcatttcccctttttcagctcagttaccatagaatacttccaagctttactacttcctctgtaagtcatttcagttatgccaggatatttgatgattttgtttatgtagaattaggtaacaaagccaattatgctatccttattattgaaggattaatcttatgacttaacataagctttggttatatttgggtgtagtctttggctaagtacccattaaggctagtagcaaacacttggaaggtggctaactgggactgggaatacgtgtctcaacttgagaaaccaaatagtgcgaagggactcagggtggccagacctgtgaccttggcctcatttgtatcttgttttcgctgaggtgatcagacacttagtaccctagaaatggactggaattattgaatcttcttctgtaacatcacaatcttcctggttttcagaataaacgtttttgtgcttttgatataaatatatactctataataaaatgtttgactaattaatatagtagtgtttgtcagcctgtactttttttttttttaaacccatgacctagtcgtagacattt

SEQ ID NO: 60442 - DNA, 401 bp, Homo sapiens
taggttccaggaagctcaaaacaagacagtaggtagagacagctatcatccttggcgttcttccttttggattctggataaaaggtagaggaataacagcaccgttctgaatgttttggttattttatggctctaatttccatcgtgttttttttctgaagcatagctaattgttcattaacagttaacagatattgatggcttagctatttttatctttttatctatttcacaaaggtctatttagaatctagtagtgtatttcctctttattgttaagcacagaaaaggaacgcatttttttctgctcatgcctagtttcctttgatctttctcaaaggtaaattacccctaaaactttgagtagactgtcctagcagatattctgaagcttgacaagg

SEQ ID NO: 60443 - DNA, 295 bp, Homo sapiens
ctccacagctgccacatagaacaagcaaatctgacatcacagctcttttaaaaatctcccagaattctacactggaataaagatcacccagtaaactcagctatgttgattcgtaggaatttctccttggagttaataataatcattagaaaaaaaatacaggaagaaataacttcctcctattcttattgtgataaattgtaacaatagcagacattcgtatatagatcctataagcgacaagagggaaaataggatttgcaaattaagcatctgaataaatattttagaaaaa

SEQ ID NO: 60444 - DNA, 456 bp, Homo sapiens
gtttggggggagtgttcttttttttattcgtgagtgggtgttggaaaaccccaagcttgagagtaaggtttcaaaaccccacggccagccaaggtcaagggaatggtgctgcttccccgaccaaaaagaaggtggtggccaaggccaaggcccctaaagctgggcaggggccaaacaccaaggctgctgctcctgctaagggcagtgggtccaaggtggtacctgcacatttgtccaggaagacagaggcccccaagggccctagaaaggctgggctgcccatcaaggcctcatcatccaaagtgtccagccagagggctgaagcttagggccagaggcaggggcggagagagaccgagcctctgccctagtttttattcttcaactaaccactgctctatttatttcattgtaagctatttatcaataaagacttttgtttctttttcctcacaa

SEQ ID NO: 60445 - DNA, 406 bp, Homo sapiens
ggacacacaaacacacagtccataacagcaatcactgtgctcagttatactgaggacagcaccagcacctggtacatgcccagcccgaaacaattagtccaactctgtgtggttactgttactgacgcaggtgggcaccatgttgccgtctttcatcctgcatgcagatgcatgaggtgacacacgtgactgcagcactgctctttatggggaggtaataaaggaatgtgaggtacagatgtaattatctaccattacccagctatgtgtttgtgtgcattttggatctacagtcagagcttccttttattaaccctagttagtattagcacagcttcttctttagctttttttttttttttttttaagacagagtcttgctctcgtcgcccaggctggagtgcag

SEQ ID NO: 60446 - DNA, 480 bp, Homo sapiens
ccagggcaggaggggtgtgggttccacacgctggtgctggtgagggcgtctcatctgccccacttgggggggccgtcggtcagtgctgccgcatgggcacgccagggtgctgcttgtctttgctggagttgcttggagggtgggttgggaggtgaaaggaggaccacagacctgaaccactccagctgcgaaatgctggaagtgtaacccaaaatgtgagaaaaaaaaacacccttttaagtaagtgggtgtgaaagtgggccaaggcctgatgccacagtcagggagcagggaaggctcagcattgctcaccctcacttaaggatggggctagcatcacataaggcatcacataaggatgggggctagcagggaaagggagagaaaacacatgaggcacacacagaccctgggaagctggtggagctgtgctaacgtcagcagaccagtgatcaaagacccaggccttggggagattcc

SEQ ID NO: 60447 - DNA, 348 bp, Homo sapiens
gaatcttaccatcactgaaggtcatctagatggatgtttgcattttctgtatgatgtttctaccaagattgtcatcatctcttgtgcccaccttccccttttccagcactgacctctgtcagaaggcctccccagttctcttctacttccttccgccatttctttagctcatcagctccttcgacttttccttctccactttcacccacataccagtggagaaccaccggaccccagtccccagctctcagtgtccttcaagctcctcttgaccattctctcccctgattactgctggaggggcttcttcctgtcccctctgcctctcctcactcccattcccccact

SEQ ID NO: 60448 - DNA, 420 bp, Homo sapiens
ctttgaaaaacaaaggcagtgaggtgaaccagcaagtgcactggctgaggggactggagttctagcctctgaaccagtttcctcctgtgccaaaggaggataataattatctattattgattatctcctagacttgtggagttcaagtgtgtaatgccttaaaagatgtggaggctgttgctgtgtttggtaccacattgcccaccctcacgtggcgctcttcagcttaggttcctctagcagtgtcaagtttgtgaaccaaccccactggccttctgcattctgagggcacgtgtgttaaagtctctactgatgtccttttggaaatgcctctgcatgaatttatggtagctctgactcatctttaaacaattttaatttatttagaaaataaaggcttatctctccaggaaatttttt

SEQ ID NO: 60449 - DNA, 370 bp, Homo sapiens
taatgtgtatgtcctagtaaaccgttttcgtcagaataataaagaccgctaagacaaatcacttcgattgcttaataatctgcttgctctacaaagaagcagtatcaggtagcaattaagcacaaggattctgaatttgagtctacctgtgtttgagtcatggcttctgcatgtactagctctgtaactcttagccttagtgttccctgttggtaaagggggaataacagtaaagttgttttaacgattaaataaggtaatacatgcaaagtatttagagaaatagctggcatatgataacctgcgttaattatctgtatgctgtaactccctgtgggaaaaaaatttaaattaaacttaagtcataaag

SEQ ID NO: 60450 - DNA, 254 bp, Homo sapiens
gggatgattagcagcctctgacataggggcatctcccccagtgaggcgtgggcagattattaaaggaatggtactgggaataaaagtggctgaggataaattttaaattctcatattacttcttacaaaaattctaagttttaaatcaagtcgtataatttttaagaataggtcttcaattgatttctagatggcaaataatttatataaacaaaaacaatggagccttctccaaaaatgaatactcaattaaa

SEQ ID NO: 60451 - DNA, 262 bp, Homo sapiens
gtaagcaagtactccagttccatcttcttgaagatgcagatctttccttagattccaggttaattggtttccttgtgaatttagctctccagtggcttcagaaaagttgtggtttttcagattaacttgcattttttttggtcattgttatgtaagagttggagccatgctctttccaactttctacatcctaagtagatgccagaattttttcccacttttctcttcaacttttgtcattggtagacttgactattatgta

SEQ ID NO: 60452 - DNA, 222 bp, Homo sapiens
tctctgcctttgcctcccatttgccttagtttttctcttcctctccccacccaccacatgttttccctaactgtgttgatttaattgtcttactcatatttatttcttttcctgcttttgacattaatcacgatatttctaccctttctgtagttagtcagtaggacccagttagttaacttttttctaacaaagtaaaacatttattagccccataaaaaa

SEQ ID NO: 60453 - DNA, 428 bp, Homo sapiens
aacagttatctaatactaataccttaatattattatctaatactagtttatatttctacagttaggcaactgtattttagcagaagaagatggtgaggaaacaaacagtttattaataggcattaataactagacttgatctgttagccttgtagaactgttagagtaatagaaagtttcagacagaactggttcaaactccagctctcctcctcactaaaatcttcatttgaggcagattatttaacttcactgagcctctgtttccccatctggaagatgaagataatagtatctaactcacaaggttatcattggaataaatgaaagaacacatgtaatgcaaccagctggaattaagtgcttaataaatgttcttttcactgctttgcctcatcagaattaaaatagaaatacttgactagtca

SEQ ID NO: 60454 - DNA, 1107 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaattagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaactttacttcatatcaacttcctggaccttattgatggttctggcccggtaaacccaccacaagataattatgaaccacatgggaacgaaagatccttatgaagaggccattggtaccttggctctgggcacacccgcggggggcggggtggcaaaagggaaaccggaattttaagaaaccaaaggtgtgatagaacaacggcgaaaaggggcgca

SEQ ID NO: 60455 - DNA, 1094 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaatttccccatctggaagatgaagataatagtatctaactcacaaggttatcattggaataaatgaaagaacacatgtaatgcaaccagctggaattaagtgcttaataaatgttcttttcactgctttgcctcatcagaattaaaatagaaatacttgactagtca

SEQ ID NO: 60456 - DNA, 582 bp, Homo sapiens
ggatttcacagtggctgctacagttgtgtatctagtaactgaagtctactacaattttatgaagcctacacaggaaatgaatatcagcttagtctggtgcctacttgttttgtcttttgcaatgtatccttcaaaacatcattaatattaatttattttgcagataacaccattagatctcatctctgatttgagaaagattttatgtcattagataacttttctttattgaaatctgttttatgtaattgaaaatatttttcaaagtaatagaggtaaataatttaaaaagctaaatataagaaaaatgccagtgccctgctttttcttatccaagtctaatgtcacagagacagccacattcacctcttttaggcatttcttttgggaattccttccttgtgtttaaatattttgtgataatgttactatttatatattattgcacctttctccctcttcccttttcttcccttctttcattctcccaaaatagttagagataacattttattaaatttatagtcacttttaccatgttgtgcctatgaaaatattatttacagccaggcattatagtgt

SEQ ID NO: 60457 - DNA, 1198 bp, Homo sapiens
ttccggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaatttccccatctggaagatgaagataatagtatctaactcacaaggttatcattggaataaatgaaagaacacatgtaatgcaaccagctggaattaagtgcttaataaatgttcttttcactgctttgcctcatcagaattaaaatagaaatacttgactagtca

SEQ ID NO: 60458 - DNA, 182 bp, Homo sapiens
cagcttggagtgggtgaggtggagatttaaatcagatgatcagagaaagcctcactgagaagaagacatttgagcaagggttggaaggaggtgtaaaccaaaaataaaatcctaagccccccactaaccaactgaatggactcctttttggccatgggcaccccagagaaacctgaaaaact

SEQ ID NO: 60459 - DNA, 1402 bp, Homo sapiens
ttctttaccctctcacgtcaaatgaggttggtatttattttaaaggtttaaaattggcctttaaaaatgaatgtatattgccaggtcttaatttctaggtactgtacatgatgatcttaccgatttttggaattcagtgcattatatgaaagacttttaagtcagtagttggccagttgactagtcttttgaagaaaacgtggaaaggagggaggtgatgacgtaactggaagactggactgcgagttagatttggacatgagtccttctgctcttccttgagtaattgtgacagactttgggacagccacttcacttgtccttgttttcctgtctataaactaaaatgtgttctgagattatacagtcaattccgttttaaattagtagtgtgtttaatattgaacatctattgaatatctaagattgcatactcttttgagggaaatgaaaagcaatgaagaataagtatgcttattgtcgaggagctatgaatctagtttgaaagaaaagcatggtatgaaaaggtgtgggagatggagcatggaagtagagggtttgtgttggaaactgttgtagaagataagataatactggatgctagagtggggtgggtgaagctgatgcatctaatattgctttccacatctttgtaaaactaagatgtagtgaggtaaatctccattgcttgcgctgcttacgcaaattttagttctgagtgccaaaaaagatggaaataatatttgagagtaggtgttacataaaagtttctgtggaatggatccgttttggtggatatcattatacaaccttcatactgtttataactggtaagtaagtatttcaactttcaggatgatattaaacttccaaactaaattaatttgaagacagttttttgggtatgtagaatccatgaactgatgttttttgtacaagtctttctagtaaaacaaaagctgtctttcactgttaatatttgtgtgccaatggcatctctgggtgaaagctacatatgtgctttttggtgtgattgccttctaaagagtaattttgaaaatttgagggctaatttttttcattagtgtataataatagtattttttgagaaaaaagatacttgttaatagttgataatttcttcaatcataagaaggaatgataatgtaaaagccttccttctacccacctaagtgcctgatttgaaggggaaatatttaaatagtaaaaatagatgtataccataagaggtcattgttactaaaaaatcctgaggccattattttgttaacccatcaacaattaacagtgttacatgttcagaactgagagaatctaagtatgcatttataaaagacaagagtgaacatggtttttatgttactgactagctaaaaagaat

SEQ ID NO: 60460 - DNA, 796 bp, Homo sapiens
ggaacagacctgcccaaggttttgggggcccaacccctcacccccaacaagttataagctgtgtccagcatacaggacatggagtcaaaggagattattctctggttttaagatttaatgctgtttttactgttgagttttgaacttaggaccagttacccctttctttttgcttatatctctattttggaatgggaatgtctatcctgtgtctgtcccactattgtgttttggaagtagataacttgttttgatttcacaaacttagagctggagggagtttgccccaggtgaatcaggccttgagtctcaaccatatctgatttagatgagacttcagacttttgagttgatgctggaacaagttaagactctgaggctattgggatgtaatcactgtattttacattgtgaagacataaattttgggggttggggaaaaatgctacagtttgtatgtatgccccagaagttcatatgttgaaaacaattaatcttcgatgtaacagtattaggaatggggcttttaagaggtgattaagacatgagggctcttcccttatgaatggatgaatgcttttatcatggaagtgggttagttacagtgagagtgtgcaaaatacattgaaatacattgagcatttcacaggagagtaaatatacacagccaaaaaactgaaggaacaagtgaagaggtgttcaacattgttagtgattagggaaatgcaaagcaagaccacaatgatactttatgtccattagattggtaaaaataaaaatcaaatgttaaagaaga

SEQ ID NO: 60461 - DNA, 3158 bp, Homo sapiens
  misc_feature (5)..(6): n is a, c, g, or t
ggccnngggccacccccgggcggcttgtagccggtgcgcggggtggctggggctacgtgcagagctgtcgcggagccggagcagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcttcggcccatgccgaacatcccaggggacctggagagccgggaggccatggtggcatttttcaactccgctggagccagtgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggaaagtacatcagccagggggcagtgtcagagacgcagcactgggagaggaggacatcgtcaggctggcccaggaccaggaggagatgaaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccgagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgtggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggataaccgtgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagcccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctggg

SEQ ID NO: 60462 - DNA, 4168 bp, Homo sapiens
  misc_feature (5)..(6): n is a, c, g, or t
ggccnngggccacccccgggcggcttgtagccggtgcgcggggtggctggggctacgtgcagagctgtcgcggagccggagcagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcttcggcccatgccgaacatcccaggggacctggagagccgggaggccatggtggcatttttcaactccgctggagccagtgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagggagaaagtacatcagccagggggcagtgtcagagacgcagcactgggagaggaggacatcgtcaggctggcccaggaccaggaggagatgaaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccgagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgtggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggataaccgtgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctggg

SEQ ID NO: 60463 - DNA, 2874 bp, Homo sapiens
  misc_feature (5)..(6): n is a, c, g, or t
ggccnngggccacccccgggcggcttgtagccggtgcgcggggtggctggggctacgtgcagagctgtcgcggagccggagcagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcttcggcccatgccgaacatcccaggggacctggagagccgggaggccatggtggcatttttcaactccgctggagccagtgcccaggaggaacaaagggtgtgctgccagcccctggctcacccagtggcctcgtcccagaaaaagccagaggtagcggccccagccccagagagtgggggaaagtacatcagccagggggcagtgtcagagacgcagcactgggagaggaggacatcgtcaggctggcccaggaccaggaggagatgaaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtgatcaccactggattgctgacagatagaggacgtgggaccgtgactatcacccctaatctgcagtggatttggctctcggcactcccaggctgggagctggatacctgccctggcagcatgactcagactgcatgacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctggg

SEQ ID NO: 60464 - DNA, 1043 bp, Homo sapiens
tgaggccccacggcccgcatgcacactctaacacatgcccacaaacaacacgcatacgtcgccctctccgccacctcccggtgcccaacaccctcaccagccggcacgtgccgcatggatctggggcgtgcagccactcggcacactgaagcacatgcgtgggcagagtcacaacacagatgctcacccgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctggg

SEQ ID NO: 60465 - DNA, 2770 bp, Homo sapiens
  misc_feature (649)..(649): n is a, c, g, or t
aaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctngcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctggg

SEQ ID NO: 60466 - DNA, 3029 bp, Homo sapiens
  misc_feature (5)..(6): n is a, c, g, or t
ggccnngggccacccccgggcggcttgtagccggtgcgcggggtggctggggctacgtgcagagctgtcgcggagccggagcagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcttcggcccatgccgaacatcccaggggacctggagagccgggaggccatggtggcatttttcaactccgctggagccagtgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagggagaaagtacatcagccagggggcagtgtcagagacgcagcactgggagaggaggacatcgtcaggctggcccaggaccaggaggagatgaaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtgatcaccactggattgctgacagatagaggacgtgggaccgtgactatcacccctaatctgcagtggatttggctctcggcactcccaggctgggagctggatacctgccctggcagcatgactcagactgcatgacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctggg

SEQ ID NO: 60467 - DNA, 2365 bp, Homo sapiens
  misc_feature (649)..(649): n is a, c, g, or t
aaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctngcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacacccgagctttcctgcgtagtagacacttgttcaagattcgtacactatttaatcctgggggggtatctatatcaccct

SEQ ID NO: 60468 - DNA, 330 bp, Homo sapiens
aacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatgggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagac

SEQ ID NO: 60469 - DNA, 1106 bp, Homo sapiens
ctgccccaccctggggattgacatcctctataaatatctatgctatttggctttgtccctttaaaaggcgggtccaggggcgtggcctccctcaaatggagcgctcactctgaccccctccttcgtgtgccccccacacactccccacgccttcattgtaaatagtcacttttgtactgggtttgagccaggggacgtggggagtcatttttcttttctttatgttggcatctcaggccactggaggcatggcccacatcccgggtcgatttgggagaattttaaggtatgtcccctcacctgtccccatcgctaaggatttcaagctatcagtattactctagagggatggggtgcatagattccccggcagggtggtgggagaggtgtggaaaggtgtagtctgggaggatgcctccgttttccccttctgtgaaatggattcatcctccaatttccctgaggagcctcagtgagataatggtggagtcagaggagctagaacctctcttccccctttctctgttggagacagggtagcagaagaatgggggacaggggaggctgcagggccatctttggagaaccgattgctaaatccttcttaggaccttaaggtagcctcctctccaggcttgttctccctcttggaatatggggaggactggaggacctctaaggtcccttggttctccccagtccttagattaaaaggcccaggccccaggctggccccctgcctgctgtcccactccttcattccatttcttggaatgtggccatgcctccagtgcctccattcaaccccctctaactgattccttccatcctctgcgaccagagacgccgcccgcctcctgcccaccacctccagaagctcctggctggggtgcactgccgtctcctcccactccccacattgccatgcctgggccacgcccaccccacccactcacccacccccagtgtccgttgtgtgacctagtgcaccatgtattagcttccatggcccccaccccagcccccaccacaccccctttccccacccctttcccctcggcgacttcacctttttttgccgcgataaacgccatctcagcatctgt

SEQ ID NO: 60470 - DNA, 174 bp, Homo sapiens
aggggctgggttggtagtctgccagagacagggaacgagattatttgcaagagctgcagcttcattaaagtcaagccctccttgtagttggtcctggacattgcttatagatgtccctgaccataatcggtcaagttcaacaccaactgcactagtccagaacagtgtctgaag

SEQ ID NO: 60471 - DNA, 315 bp, Homo sapiens
gacaacttacagtcaatgtgataagcaagtactgtgccatagtttagttggcagtgttttttaactatttagtagtacatatagtaatgatgtatttcctcagagctgatgaaacaggatggtgaataaacaaaaggtagatcagtggatatggtaggctaccaacattactaccactcatctaagaattaaggaagtatatccatatttgccgaaggaaatactaaaaggaaaccagcaactattaaaactggatgccttataggagacaaaggggatttggtagacacagggataggggtagaaaggaaattt

SEQ ID NO: 60472 - DNA, 258 bp, Homo sapiens
ggctgcctggggactgctggtttgcaggggaagctgtcctcatccaaaagaagaatcaagttttgttttcctgtggttcccttgctctcccccggcctcacctcgagcttccacttgggccctttcccatgcttctacttgagccccgcctgcctcaccgtctgcctcaccgccacctcctgctcagagtgagtgcatgcatgccagacagatacacatatacatacacacacacacacacaccctattttttttttt

SEQ ID NO: 60473 - DNA, 591 bp, Homo sapiens
tctttaaatgtcaacaaagagtcagcaggcagtgtgtcagctctgcacctggccacatttcctatcctctgttgcaacttagtgaagctacgtggccaaactagagccaacggaacataagtgggagtgatatatgtaatttgggggcattttccacataaaataaaagctctttgccatggaatccctttgtctttccccttcccatgtgtggtcacaggaatgactatgacccaccttccaatcatgcagatgaggataatgcccaaggggataaacttttggggaaaaaatgagtccactcaccaatccatatttaaagacttatatgtgtggaagaaataagcttttgtgtgttttttagtcactctccttcagtctctatactacagcagttgaaatagaccttacataatacacaccctttctaggtacctacaggtcttctgcaaaagcagccatacaatcttcagattgtgaccaagttgcttttaaaattctcatccaggttgcctcttttttctctctcttggttgtagcaattctcatcagtagtgctgccaaagttgaatcctctttcgagcacatgca

SEQ ID NO: 60474 - DNA, 117 bp, Homo sapiens
gatatattaattagctggatttgtttatagcacacaaatcaaaacatcatattgttcaccataaatatgtgatgttttgatatatgtgaaacatatcacatatataagtatgtgaca

SEQ ID NO: 60475 - DNA, 421 bp, Homo sapiens
tcttactctgttgcccaggctggagtgcaatagcacaatctcagctcactgcacctccgcctcccgggttcaagtgagtctcctgcatcagcctcctgagtagctgggattacaggcacgtgccaccacgcccggctaatttttgtatttttttagtagagacagggtttcaccatgttggtcaggctggtctcgaactcctgacctcgtgatccacctgcctccgcctcccaaagtgctgggattacaggcatgagccactgcgtctggcccgagtcatactttctctatggcaaggcggtaactaaatgctcactatttattgagacaggatttcacctgtcactatcaccaaggctagagtgcagtggtacgctctcagctcactacaacctctgcctcctgggctcaagtgatccta

SEQ ID NO: 60476 - DNA, 2752 bp, Homo sapiens
  misc_feature (200)..(200): n is a, c, g, or t
gggcaatggcgggcgccctcccccagcctcgttgccgccttgcagtttgatctcagactgctgtgctagcaatcagcgagactccgtgggcgtaggaccctccgagccaggtgtgggatatagtctcgtggtgcgccgtttcttaagctggtctgaaaagcgcaatattcgggtgggagtgacccgattttccaggtgcntccgtcacccctttctttgactcggaaagggaactccctgaccccttgcgcttcccaggtgaggcaatgcctcgccctgcttcggctcgcgcacggtgcgcgcacacactggcctgcgcccactgtctagcactccctagtgagatgaacccggtacctcagatggaaatgcagaaatcacccgtcttctgcgtcgctcacgctgggagctgtagaccggagctgttcctattcggccatcttggctcctagtatttttaattaagcacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagcaaaaagaaaa

SEQ ID NO: 60477 - DNA, 2049 bp, Homo sapiens
cctaccgcaaccaaattaccatcgcccgcgactacaaggcccagcacaaccgcgctactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagcaaaaagaaaa

SEQ ID NO: 60478 - DNA, 468 bp, Homo sapiens
caggctgtgaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtctttttttttttttttgtcttttaagagcattcaaaaaca

SEQ ID NO: 60479 - DNA, 539 bp, Homo sapiens
caggctgtgaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacctcaagaataacatttacatatgaaagaaaataggagatggctcagaataatatgtccaaggccacgcccaggcgtcagggattcatgaattttgtatacagtgtatgatgtttctagattaaaatattttcaaaggtaaatga

SEQ ID NO: 60480 - DNA, 321 bp, Homo sapiens
cgtgcgcacaagcgcgaacggcgagccggtccgccagcgcagcaacaccgccacccaaaccctttgattggaagttgactgcagttgaataacagaacaaaaacggagcttcaaaatcatggcgtgcctgcttcttctgggttcttttaactgcaagcaatcagctttgaagagcacctcaagaataacatttacatatgaaagaaaataggagatggctcagaataatatgtccaaggccacgcccaggcgtcagggattcatgaattttgtatacagtgtatgatgtttctagattaaaatattttcaaaggtaaatga

SEQ ID NO: 60481 - DNA, 307 bp, Homo sapiens
tgcgtccctcctccatgggcaccattccaagagaaacgataacaacgactttattggaagttgactgcagttgaataacagaacaaaaacggagcttcaaaatcatggcgtgcctgcttcttctgggttcttttaactgcaagcaatcagctttgaagagcacctcaagaataacatttacatatgaaagaaaataggagatggctcagaataatatgtccaaggccacgcccaggcgtcagggattcatgaattttgtatacagtgtatgatgtttctagattaaaatattttcaaaggtaaatga

SEQ ID NO: 60482 - DNA, 288 bp, Homo sapiens
ggcacagcgccacgccaacacaaccagagctaaaaacctgttagcactgctgcgcttttaacagacaccacggagcttcaaaatcatggcgtgcctgcttcttctgggttcttttaactgcaagcaatcagctttgaagagcacctcaagaataacatttacatatgaaagaaaataggagatggctcagaataatatgtccaaggccacgcccaggcgtcagggattcatgaattttgtatacagtgtatgatgtttctagattaaaatattttcaaaggtaaatga

SEQ ID NO: 60483 - DNA, 303 bp, Homo sapiens
actgcacattcgacaaaagccgtgcacacccacaaatagcttgctttgctctctaagatcctatcaacggagtgtacttggcctgtatttagacaaagccggtggtgttgtttacatctttggcagcttgctcagtgtggcttttctatgaacaaaatgtgtgcccagcccggtgggtctggcttctcagccaagcgattgtgtattgattggtggtgggaaatgagatatcttttcagttggtccatgtccaaagaaaaaagtgcctaattggacatctgagatgatatggaaaaaatgaga

SEQ ID NO: 60484 - DNA, 1002 bp, Homo sapiens
ttctagcccacggaaacttcgtaagtaggagatgagttacgttctcattttacaaatgagcaaactgagtttctgagggtggtgtgctgggaaaggtttaacaaccagctctctggggaaaagatgtcaggctctgattgataatgtgtgctcatttccatggtgtaaacactctccccatggcctttttcaagctggcagcacgttgctgaatgtacagttgggaagagatgtggacaaccacttagtcctcgagagcctgttgtgcaaactggctccagcacacctctgcgttcagagcagggaaatgacaagtccaaggtcacatggatagttgactcctgagcccactttccttcctctttcttacagagcaaagcagtaccgggtcatccaaaaactttatttaaaaaacaaaacagaaatgtgtccacatcttgcagagctggacaaaagaaggtggtcaagagatcccaaattggtggaaactgtccccgttacaggaggaggaaggacgctgccaccactaccccagggactggcctatactcatgcttctgttccagtgttgctgtctcacatttgaaaccaattttgaatttgggtagaagattcgtcttgttgcctaaacaatgccttaaccccattctctccccagaagggtcctacatttcttaagctattttcagctcctccacacctactcacttgcaatacttgtcataacaggaagccagtttcatatactgtaatccccaaacacattgcacccacacgtggggagcgtgaggggctgagcgaggagcgaggaggccaggccttccaaaaactggaggggctgagcactgagccgctcccaaggtggggcgtctccactcccaagcccaggattcagaagccagaatccacatccagacattcttgttttcctttctcatgcagttgctggtgacttttttttttttaataaagcatttgagtaggcagcaaagccagtcagaa

SEQ ID NO: 60485 - DNA, 375 bp, Homo sapiens
caaaaaattacaaaattatctgggcgtggtggtgcgtgcctgtagtccaagctacctgggatgctgagtcgggaagatcccttgagctcaggaggtcaaagttgcagtgagctgtgatcatgccagtgcactctagcctgggtgacagagtgagaccttgtcttgagggggaagggggcttaacaaacctcaccttaatcttattccttgatatacttttattttttcttaatctctttggttctgtcagattagtatttcttaaagatatgtggcagggtaatttgaagactccaggattatcttcttgtttgtattttattggtttaataactttagaataattatgtttctgagaactaacacctttacaga

SEQ ID NO: 60486 - DNA, 573 bp, Homo sapiens
tcagaaactggcacagcagcatctaagcatgacattcaaggacatttagaagctggctttggcccatggtttgtgagcctcacccattcatttaacaactgtttgttgtgtgtctactgggtgccagacactggtctaaggcaccgagcgcccagtaggaaaccaaatggacaaccccctgcccttgtggattgtatatttttgcttcaatggtcttgtctctactcagctaaaatggactttgtaccccgctatttatgtcctccctcatgcaaaggggttcaaataaagcaattgggaaaaaaaggtgggagggatgaggggacgggaagaagcttggtgtagcaggaagacctggaaagacctcaaccttggggctggactccaatcatagcaatttaccagctgtgtggccctgggcaaagcccttgacgtctctgaacttcagttctctcatctgtaaaatggaactaataccagcatcctgaagaggatccctgagataacatacatcactttgggcccagcgaggggcatagggagagctcaataaatagaagctggaactcaaaa

SEQ ID NO: 60487 - DNA, 347 bp, Homo sapiens
accaaatcaaaaaacagaagatttattggaagctatgttggtttgtctgttgtggccaaagacttactaaatcacaagttagctcaaacaagaagagaaaaagaccaaatagaatccagaaaaattttaaagtccaaatttccatctgaaaaccagactagatgtttttacttaaaatgagataaaagaggcaatttactataaccaggcacccatgaagagtagattctaagtggtcatgggctagacatggcatttcagcacaagccatcagacccaatatctcacaagatctggtatctttcaaataattccccagggcaatagaccaaccaattgagtggtgc

SEQ ID NO: 60488 - DNA, 480 bp, Homo sapiens
attcttttttcctcatatattccagacttgaaattgaagaagtagcaacctagaaataccaacaatgaccaaaataaaattccaataaagacctgcttttggtagccaaaagaccaggagaggggcagactagcaagacagaaactttcagacaattactgctctacatccaaacaccacaaaaaagactatagttctattctacccatgctagcaaagaatgagtgggaagacatttccacttctatggggttgtaatgaggcacttcaacatccctgacacagagattctagaaaaggccagtaggaagctgggaccttcatctccaccagtaagtaataaagtcctactccctttggtgtcagtggacaaaatgtgggaagcttggattttcactctcacctggcagtcatgaggtgcttctctccatctgtccggggagctatccaaaaaggccgagcggagaagaggaacttttg

SEQ ID NO: 60489 - DNA, 4921 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60490 - DNA, 841 bp, Homo sapiens
taggctaggtcgagcctgggtggtgaattcgccgaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaaaacggcagatcaggagtctcgcggagcagcaaggctggag

SEQ ID NO: 60491 - DNA, 667 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcgggagctgctaagccgcacatctcttgagacccagaagctcgatctgatgactgaagtgtctgagctgaagctcaagctggttggcatggagaaggagcagagagagcaggaggagaagcagaaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaa

SEQ ID NO: 60492 - DNA, 548 bp, Homo sapiens
cgtccatttttttttcatatagatattcatctgttgaaaagaccatcctttctctaatgaattgcctttttgcttttgtcaaaatgttattagtctgtatatgtgttcgtctacttctggattctctgttctgtttcattgatctgttggtctacatttataccaataccacactgtcttgattactgtagcttacattaaatgattactgtagcttatattaaatcttgaaatcaagtagtgttaatcttgtaactttgttcttttcaaagttgttttggctattctgggttctttgtatttccatacatatttagagtcaacttgccaacttctgcaaagaaacctttcaagattttgattgatatttgacatcctaacagtaccgagtcttctgatccattaacatggcatatctttccatttatttaggtcatctttaatttttctcaacagcattatgtacttttcagggtacaggttttatatgtcttatcagatttttccctaagtagttcatattttttggtgttattttaaattgtttt

SEQ ID NO: 60493 - DNA, 4957 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaagagatcattgaaatgcatagtttattctgaattttaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60494 - DNA, 3737 bp, Homo sapiens
gcgacggcccatgggtgggcgaaaattcgtgcaacgaagggcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60495 - DNA, 5499 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaaaaaaaaagaaaagaaaacacagaaaaacaaaacgttgtgtgtgggcgcgcgcccggggcccctccgaggaaaaggcgttaatagagacaaccatgcggtgtggggcgcgcgcgggcggccccagagggggatcacgcgggacacgcgtggggcccaccaaccggggatcccccaggggaagaaacccgggggacaagacaaagaaagggcggggggatcttccccgccgcaatgagaaaaaagcgcccgggggggtcacaacgagaagggtcttcggcgaaaaagacccccaagaggcgggacccccgggagaggcgacaaacaacgggggggaatcatagcaaccacgcgggggaagttcccaaaggagcagaggcgcaagacatccaaaaaatataggcgcccgagaccctggggggggaagaaacgaagcagaggaacggcaaaagagagcagaaaggaaacaaaggaacacaacaggagagaagcagcagaggaaccagcaagcgaggagggcagagagagagcaacgcaggagagcaaagaagaagagagaaagagagcaagcgccaacacaa

SEQ ID NO: 60496 - DNA, 2914 bp, Homo sapiens
tggctggaaatggaagagtagctagattcttaaagaatgtttgacttgatttatttgtgtgtgtatttatgtgtgtgtgtgtgtgtgtgtgtgtgtgtattctcatccagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60497 - DNA, 2557 bp, Homo sapiens
cctctactcagactggtctctccacactggcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60498 - DNA, 2596 bp, Homo sapiens
accagtcagcaagtagtagctgaatacatcactactgaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60499 - DNA, 4869 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagctgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60500 - DNA, 4863 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcactgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60501 - DNA, 4799 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaatgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60502 - DNA, 4981 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagggttatcatgaagattaaatctcttatgtcagtgccagcacatgctgagtgttatgtgagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60503 - DNA, 4887 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatgagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60504 - DNA, 4847 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatgagatcacctcctacaccactggattgccctgctggactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60505 - DNA, 4656 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcactgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60506 - DNA, 4433 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaatctacagctatgtagaaggattacactagccgaaatgccttttaccccccctttcacgtggcaaacggtggatggagacagagcgcaggacaggagccgcaaaatagagaagcgggaggccacccccgacggtgcccaaggtggaaacccgagggccccgagatgagccgtgcaccggggcggaaagctatgtacgtagcccggcaata

SEQ ID NO: 60507 - DNA, 1789 bp, Homo sapiens
tcgaaggtcatctctagcacattcctgggaatctgcatgatctgtgtctcacccaattctcctgatatacagatccatgggttgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60508 - DNA, 1877 bp, Homo sapiens
cgtcaatatttttcactgcatttttcacatcaacagagttgggtttagggttccccaggagagcaagggagatggatgggtccctcccaggggtgcgaggaagagggctacgtccagcatgtggggagtgagggacaagggcacagggcacacactcatacactgggcactggagaaggcagtcttttgagcacagacaccaaagagttaaacagtcaccacctggtacagtgttacaaaatggggagagtgaccacagcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60509 - DNA, 1693 bp, Homo sapiens
taccctgttttccctccatactgatgacccaatagagtccctgggcccctagtgaacagtgcctattcctgtcctcttctagatttgcctgggtctccttgaatagtggccacactggctttgtcctccagtggagaatctccttgtgtgtgacccagatccatcatctcttctttcatccatttattcagcagctcttcactgggagctgctctgagccaggcactgtgccaggtgttagggaaacagacaaagtcctagcctgtcttttgcagccctcccaactctgggctgtgggtttagggatgcaatggtgggagggcagctcggctgagacaagcctggcaccctcccctgtttccttacgtagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 60510 - DNA, 3716 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagaggtgagccttcctgccctccaatccagggccttacattgaataagagagaataattttgtttttccgattatcttgttatgctcttccaggcccatgtgctgtggacaccctagagtct

SEQ ID NO: 60511 - DNA, 2572 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagtctgtatatgtgttcgtctacttctggattctctgttctgtttcattgatctgttggtctacatttataccaataccacactgtcttgattactgtagcttacattaaatgattactgtagcttatattaaatcttgaaatcaagtagtgttaatcttgtaactttgttcttttcaaagttgttttggctattctgggttctttgtatttccatacatatttagagtcaacttgccaacttctgcaaagaaacctttcaagattttgattgatatttgacatcctaacagtaccgagtcttctgatccattaacatggcatatctttccatttatttaggtcatctttaatttttctcaacagcattatgtacttttcagggtacaggttttatatgtcttatcagatttttccctaagtagttcatattttttggtgttattttaaattgtttt

SEQ ID NO: 60512 - DNA, 2321 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcaggtaaggcctccttggaaatgtacattcaggcctcttggattatggcattaacatgtcccttttcctaaatatgccagcctctttatctgtttctgcctttgtgtatgtggttcccattgcctgcagtcttcttccttgttttctttttgcctggttatcttcttctcatcctttaacactgttagttaggaatggatctcattg

SEQ ID NO: 60513 - DNA, 2543 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcgtaagtcagtgcttactagagccttctgcctgcctcaggcttctttgctttccatgttcagatacagtgaggctgactgtaaaggttaagagctattacagtttgagcaaaacccagatcttttgcaggtaggtggtggatggcaaattgatagacatgagagggccagtatttctgattaactatcttcatggccttttgctgggcattccagtcttggaggggaacattgcttcctatgtcccttctgattgaagtgaaaagaggggtgggtaggaggtgatggtcacaggaagctgactttccatcagttctgttctgtcattctgcagagttatttctgcctcttcctcagcctagtaaaattgaggattcacaaaggataatcctttatatattgagaaaatgtggatgtgttgcatctttttgttgtttgcttaactgaattgttttcataaatgggaggttgagtgtaagcagcatatttggacaaaatagtaaagtagattagaaagaaacagatgcttacttaatgagccaggctagtaacatgaaattcattcattcagtacatatttactgagagtgcactatgtgtcaggcattgtttcaagggtagtggtggacaagacagaaaaattgttgctatagtggaacttaaattttagtgggagaagagaggtgattaaataaatatataaaatatgtagtttgtaaggtacttaataagggttataaagaaaaataaaacagggaaagggatagtatttggggaagagaagttccagtttgtaatagggtggttaggtaggcatccctgagtgacctgttaatatctgtaggaaaagtattccaggcaaagggcacaggaagtataaacggtctaagacaagaatgtgcttcgtgtattcaagaaccagaagctgggtggatggaatggagtgaatgagcgggagtatagtaggagatggtgttagagacttaactggaggccagatggtatagaatcttgtaggccattgtaaggactttggcttttactcttaaatggctcttagatagccatcagagttttcaattttttttactttttattttaaaataatttctagctacggaagattcgcgaggggtattcaaaggactcttgtataacctatcccaaattcaccaattgttaacattttgccacatttgctttattatgatctctgtgtgtgaacataactgaaccattgagagttattgtgactcctaaattctcatgtgtttatttcctaagaataaaaacattctcttaaataactatcattgatcaaatttggaaaacctaacattgagacaatactatattaaagtttctctggtacccgataatgtctg

SEQ ID NO: 60514 - DNA, 1906 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
  misc_feature (1894)..(1894): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcggcacatgcgttgggggtcctctagatcgacngcaggcagcaag

SEQ ID NO: 60515 - DNA, 2102 bp, Homo sapiens
  misc_feature (10)..(10): n is a, c, g, or t
  misc_feature (12)..(13): n is a, c, g, or t
  misc_feature (16)..(16): n is a, c, g, or t
  misc_feature (18)..(19): n is a, c, g, or t
  misc_feature (22)..(22): n is a, c, g, or t
  misc_feature (37)..(37): n is a, c, g, or t
aaggcatccngnntcngnnggncggcccgtgcccccncgccccgtcacggcaccgcggcggccgaggggaccggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgcacgcttagaggaacgaagcccgtgctcatactttccgcttgtccaaatctt

SEQ ID NO: 60516 - DNA, 251 bp, Homo sapiens
cagatgctggtgtgcttgggagccaggtactgcagacccagggcccagagtgcacagcggttagccttggtggtggtgttggaggcctggtgcagtgcaggggtgaggaatggctcatcaggtgcccttagggagatgaggccttagaaggtttcctagaagccctgaatttcctctgtgtatcgtgtatggtcacacactgcataaaatgtgctgcgtaacaacatttgtcagtgacggactgtttatgg

SEQ ID NO: 60517 - DNA, 449 bp, Homo sapiens
tttgtgtatttttagtagagacagggtttcaccatgttggccaggctggaatcgaactcctgacctcaagtgatctgcccgcctcggcttcctgaagtgttgggattacaggtgtgagccaccgtgcccagctgcttttttctttcttatccactggtcccttaccaggctctctttcccatctcctttctattcccagtaggggaccctttcctttttctgttaccttccattgtttatatttcttctggattttagtaaattgatatatttgcatacactgtgtcctggatgtacattgaaacaagaaacagtacatatatttttttagcaaaagcttctatctgtatgttgaaagccttgacccctgaaatctaaactgataggtgtttctcccttgcattggttccaggggaaatcagccttatggtcccacctgttacattatc

SEQ ID NO: 60518 - DNA, 226 bp, Homo sapiens
gggaagcttactactgtccagattggccatgataactctgggctgtatgccaaatggctggtggagtatgtgatggtcaggaatgagatcacaggacatacctacaagtaagtatacctcaggctgtaaggtagaggggcaaggtgtatctacaggagctcttcgatgcttgggtatgtggagttcccaaggagaccctttaggttgtgataacctgaggcaactt

SEQ ID NO: 60519 - DNA, 3519 bp, Homo sapiens
ggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccactaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattttttttatcctggggccacagttcttgattattcctcttgtggttaaagactgaatttgtaaacccattcagataaatggcagtactttaggacacacacaaacacacagatacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacacaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgatttagctttatttaaagtcttctgtccagctttaagcactttgtaagacatggctgaaagtagcttttcta

SEQ ID NO: 60520 - DNA, 1729 bp, Homo sapiens
agggcggcgcttaagattgtacattactggtcccgtcgttttacaatttaaactgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattttttttatcctggggccacagttcttgattattcctcttgtggttaaagactgaatttgtaaacccattcagataaatggcagtactttaggacacacacaaacacacagatacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacacaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgatttagctttatttaaagtcttctgtccagctttaagcactttgtaagacatggctgaaagtagcttttcta

SEQ ID NO: 60521 - DNA, 443 bp, Homo sapiens
ggaatgtgcagtagcagaaggaatcacgtatataacatgttttcaggtagctcacagacaaatgaaaaaagctacctttctgtgtatacacagaaaaaccaacatcataccacttttgaagacctttttaaatagcgcagaatatacgcagtagcagctgaatgtgtatgtgggagaaaacgcgagaaaaaatggtctgtgccagtgtaccaaatacccgcagtttgctgaagatctttaaattttctgtccatctttctgcagccttatcctgaacatatgttctctccataaactcatttggccaaggaactatatagctacttgaaaaatatttgtcccacaggtgataagtgatgtattctcctttcaattaataagcaaatagaacatcataatcctcttttaacctcccatccctaatcctggtccctttcctcctt

SEQ ID NO: 60522 - DNA, 337 bp, Homo sapiens
ataactacaacattttaagacatagtgtaataagatataagtagaaacatcagaaggttaaaaagcaggggatgggctgggcacggtggctcacgcctttaatcccagcactttgggaggccaaggtgggcaaatcacgaggtcaagagatcaagaccatcctggccaacatggtgaaacctcatctctactaaaaatataaaaatcagctgggcatggtggtgcgtgcctgtagtcccggctacttgggcggctgaagcaggagaattgcttgaatccgggaggtggaggttgcagtgagctgagattgcaccactgtactccagcctggcgacag

SEQ ID NO: 60523 - DNA, 322 bp, Homo sapiens
aaaacaaagtcagttgtacaaatggaaaaagtgcaaatgaaaaatgatgacctttaacaaggcaaggacagtaagaataagaaaatactggattgcctctcattctctgaaaaatcctaatgaatatcagatgtagtgattttctaccttccccaatttatttcactctcctcccacagctgataaataatctatgaaatacagttgtcctgccccttattttacttgtcattatttgttttcatttattttgactgggttaatgcactaatggctcatttatctacgatgatcaaaatttggttgcaaagacagccctaaa

SEQ ID NO: 60524 - DNA, 375 bp, Homo sapiens
gggtccaggggagaatcaatatatctagtatagtttatatttgtaccttctctccttaagagttacagtgagtgactctactcctcaaatggagcacctctctccaggagagtaagaagatcacataaatagaaagtgagctttggactctaacagacataggttcatattcaactctgctacttaatatccatattggtttgagttatttaaccttgacaatccacactgtaaaatgggtaaataataaataccctcctctcagaagtgttacaaagtttatatgaaataatgtgcttaaaaagctgggtacatagtaggagcttagtcattgtttattttctccctcatacccatacatgattcattctactg

SEQ ID NO: 60525 - DNA, 996 bp, Homo sapiens
  misc_feature (2)..(2): n is a, c, g, or t
  misc_feature (25)..(25): n is a, c, g, or t
  misc_feature (87)..(87): n is a, c, g, or t
tnccccgagttttgggggtccattnccatgcccctatccaatggaaggggccagaccagaggagagaataccctcaagtcctttccngataaaaggccttgccttgaggggagccttataaccttggcacctagagggtttacccactttgtggatttgatttatccaccaaccacagcaaccaataatgtcaagattctaggagtttatgaaagaggctagtatgttttcattttgagtcagacattcttttctcattctcaaatctgttttaaatgctccaattttaaaaatgccaatgaaaattttataatgcttctgtagtaaccatatgcagtttactttgaatttaggaaaacagttttgtatgatgaaatattgtgcagaatctcactaaggccatctagttgataatcgactggctactttccatttttttttcttggtcttcctgctctggagatttttgtctcttttctcttgagactaatctctctcaagaaccttactatttaaagtgtgatctgtgaagcagtagcattagtatcacttgggaacttgttagaaataccgagtctcaggccctgtcctacacatttttaattagaatctgcattctaacaagatccccaggtgatttttgtgtgcattagtttgagaagcagtcctgtagaatattaatttttatccctactgctcctggatgagttcaagtttgtatcatgttagttccaaggtcagcaagttgtcagcaagttggtactatattccctgactccttagtgcaaacctatgtgcacccttttcacactcctgtaatattaggttacatatacattttttcttctttgtgtatccttatactgtaactttcttgaaggtagtgatcatatccatttacatttgtatctccatgttcaaacagcgtaggtacccaaatatttttgtaaatacatgaacaaaaaatgaataaattcttctttggcaaaaaaaaaa

SEQ ID NO: 60526 - DNA, 676 bp, Homo sapiens
tttcttgtccctacctccttcctatttatttctaaatacatatcatctagcttctcacctaccactccactgaaactacttccactaaggccatctagttgataatcgactggctactttccatttttttttcttggtcttcctgctctggagatttttgtctcttttctcttgagactaatctctctcaagaaccttactatttaaagtgtgatctgtgaagcagtagcattagtatcacttgggaacttgttagaaataccgagtctcaggccctgtcctacacatttttaattagaatctgcattctaacaagatccccaggtgatttttgtgtgcattagtttgagaagcagtcctgtagaatattaatttttatccctactgctcctggatgagttcaagtttgtatcatgttagttccaaggtcagcaagttgtcagcaagttggtactatattccctgactccttagtgcaaacctatgtgcacccttttcacactcctgtaatattaggttacatatacattttttcttctttgtgtatccttatactgtaactttcttgaaggtagtgatcatatccatttacatttgtatctccatgttcaaacagcgtaggtacccaaatatttttgtaaatacatgaacaaaaaatgaataaattcttctttgg

SEQ ID NO: 60527 - DNA, 15170 bp, Homo sapiens
gcagcaaaaataaaggacgcgaccgaattccgcctctgcggagccgggctcgggtcgccggagccgcgccccaccccgccagctccagagccacgtgactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccgatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagaggtactggattggcctacctggcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccatactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctgcctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60528 - DNA, 604 bp, Homo sapiens
cgcttgcatgattgtaggtggcatcgataaacaccggtgtttatcgatgccacactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatccgataaacaccgggtcctctagatcgaccgcagcagcactgca

SEQ ID NO: 60529 - DNA, 496 bp, Homo sapiens
atgtcaatgcatcatttttattttcagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatgggtaaagtttgaaatcaattaatttctatgtttttctgcaagctgtgagagctagctctaaattggtttatgtgagaaaaaaatgtgccttggttattgcatatgttcaatacatgttgagtagttcttttcctagcagaaaaaaa

SEQ ID NO: 60530 - DNA, 542 bp, Homo sapiens
gtgactcagttttcccacttgtaaaaatgggatgttagtatctgtttcataggtgctatgtgaaagtagaaaatgagataatccatgtaaagcatttataggagtggctagagcatagccagtcattaatgactgtaactattgctgtcatcctcgttttccttgtcatcaccattattttaggtgactattcgcagttttgctaggttatggctacaaattcaatttaaaactaaagaaattaggccggttactgtggctcatgcctgtaaacccagcgctttgggaggccgaggtgggcggatcacttgaggtcaggagttcatgaccagcctggccagcatggtaaaacccctgtctctacaaaaaatagaaataaatagccaggtgtggtagcacatgcctgtagtcccagctacttgggaggctgaggtgggaggattgcttgagcccaggagtttggggctgcagtgagctgtgatcacaccactgcactccagcctaggtgacagagcaagacactgtctctttaaaatttaaaa

SEQ ID NO: 60531 - DNA, 279 bp, Homo sapiens
gcggccgcctactactactactgctcgaattcaagcttctaacgatgtacgggcttgaagctgtgctgccagcttgtgaatctggtgtagaagatgatcaaatggcccaggtttttatttttaaaattattagaagatgttttccatatttgcaaaatgattcacccaaatctgtacttaacagtctcttcagttgtaaatgtgtcttttattcaatagcataacgtttacttttaggactgctttctttattatttcacccccaaggagagggcaaaa

SEQ ID NO: 60532 - DNA, 304 bp, Homo sapiens
ttttctgacctttccccattctgttctttaagttttcagaattcagtagctgacagcctaagattttgcattagatttcttgaagctgtgctgccagcttgtgaatctggtgtagaagatgatcaaatggcccaggtttttatttttaaaattattagaagatgttttccatatttgcaaaatgattcacccaaatctgtacttaacagtctcttcagttgtaaatgtgtcttttattcaatagcataacgtttacttttaggactgctttctttattatttcacccccaaggagagggcaaaa

SEQ ID NO: 60533 - DNA, 11939 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagagcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccatactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggtaacattctggtgtttttgaagactgtctgaaactatggaaagtatatgacatcagagtcattctcccttggttactaaaaaagtcattactatatcccaaagggcaagatccattgggaaatataagtaattgtcatcctgaattagcttaattttttataaatcagagataccataattgcttggtaaaatgagatattctatacatattaagtggtgactgttactgtgatagtggatataattgatactacagatagacgagtcataagttgttagtacattaaaatagaaactccatgggagcacatccatccaaagaatctccaactgatgccagaatccttgctatgaagaatgatttatttatattaaacagaagttacaaatgtatatatttatagagagccctctaggcgagtaacataaattcatgaagctagggttagaaggtttggagagggtaaaaagca

SEQ ID NO: 60534 - DNA, 13533 bp, Homo sapiens
ctggccccaaattcgcaactcatggggtgaaggagactttaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagagcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccatactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctgcctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60535 - DNA, 9696 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagagcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccatactacctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaagtggaaagtgatc

SEQ ID NO: 60536 - DNA, 8238 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaaggtatgttatctgattttttttttttttgcttttgtgctgttgagattattttcataattgtcagaagtgatacattctgtaagtgatttgt

SEQ ID NO: 60537 - DNA, 5650 bp, Homo sapiens
ggtgatctagaggatcccggtcgctcgttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctgcctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60538 - DNA, 4424 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatgggtaaagtttgaaatcaattaatttctatgtttttctgcaagctgtgagagctagctctaaattggtttatgtgagaaaaaaatgtgccttggttattgcatatgttcaatacatgttgagtagttcttttcctagcagaaaaaaa

SEQ ID NO: 60539 - DNA, 2943 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacaggtaggcctttgcttgctgtgtaagtaaaccagtagtatcctaaaaatttggactgagaaggaaataaaactaataaattgccat

SEQ ID NO: 60540 - DNA, 3044 bp, Homo sapiens
tccataatgtgtgcccagctctcagcaaacattctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60541 - DNA, 425 bp, Homo sapiens
ctcacctacatgtatggcagttaagaactggcgaaatattcagaattattttatgcatgcaaataaaatgccttttttgttttgttctgagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagaggtactggattggcctacctgggtgtgtgtgactgcagcgggggctgctctgacttattttcctgccctcctgttcatatagcttactaacagcagccttgcctagagttgaaacactctaaaaagtcttttatc

SEQ ID NO: 60542 - DNA, 545 bp, Homo sapiens
aggcaggcaggtccacttcgaaatttgctcttcagactgatggactcaactgtcccagatgaaatccaagaggtaagagaataggacttgtgaatctgtatctcaaaccacgtctttctctgagattttagctatacaatatattcaactgtacattggacaatttcaattggatgttgtttcccttactcctgttttcttggtgagagtatttttggttaactcatccttgagacaaaggtcagatgccatctctgataaactttttattcctgctctcccaccagatttggtttttcttgtatatgttctcattacatcacattgtattctagttgcttatttacaaacatgtcactcttttttcaccagaagatgagttcctgagggcaaggacctagggcatggcttggtcagtagtagtaactgaataagtggactggatcatctactagaactgtaaccagagctaaggagagaaaggtcagcttaaggaggaagaagtggcctagaatagaatactggttataaataaggagagtata

SEQ ID NO: 60543 - DNA, 583 bp, Homo sapiens
aggctgaggtgggaggattgcttgagcccaggagtttggggctgcagtgagctgtgatcacaccactgcactccagcctaggtgacagagcaagacactgtctctttaaaatttaaaaaaaaattaaaaaaaaaaatttttaaaagcattggtctttgaagatccagttttcagtgaagtttatgtaaagtttattgctatattaataccaaaaatggcagatttacttttttcttagtttcccttcttaaaaattttctttctccttggttctgtcttagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggcatggaataaatcaataagatattctagctgatcattgtttctcatttcttctgtgttcgcttagacaccctcaggaagatcaggatcaccagttgtacctaacctcatgtacattttgctatggtctaattgataattttaact

SEQ ID NO: 60544 - DNA, 430 bp, Homo sapiens
tattgtactctaaccttttttattctgatgtgtgcttatagagtttttagaaaatcttcaaaaaaagtaataataataaaataaatgtttatcttagaatagattcatatgaaatgtcagaattttctaagtgttaaaaatactgtttttggcatacagagtttcatcatgtctgagttaagtgaagaactctaaaatatgtttttttcctcaagcttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatca

SEQ ID NO: 60545 - DNA, 652 bp, Homo sapiens
cttaattgattgcaattcggaaatatttttacttaatgcatattgacatgttttggttttatgtgatcaatttttttaagtggctgtcagagtggcttagtatgtgtttggcgcattcctcaagatactacacagaccaatgtgactagtgcagaaggatggtgggaccaggaatcaaattgccaggtaacattctggtgtttttgaagactgtctgaaactatggaaagtatatgacatcagagtcattctcccttggttactaaaaaagtcattactatatcccaaagggcaagatccattgggaaatataagtaattgtcatcctgaattagcttaattttttataaatcagagataccataattgcttggtaaaatgagatattctatacatattaagtggtgactgttactgtgatagtggatataattgatactacagatagacgagtcataagttgttagtacattaaaatagaaactccatgggagcacatccatccaaagaatctccaactgatgccagaatccttgctatgaagaatgatttatttatattaaacagaagttacaaatgtatatatttatagagagccctctaggcgagtaacataaattcatgaagctagggttagaaggtttggagaggg

SEQ ID NO: 60546 - DNA, 15328 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagagcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccatactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctgcctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60547 - DNA, 15304 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagagcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccatactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctgcctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60548 - DNA, 12208 bp, Homo sapiens
cgcttgcatgattgtaggtggcatcgataaacaccggtgtttatcgatgccacactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaatgccccaggttttaaagagccagaggaaagtatgtctacaagtccccaggcctccatcattgcaatggaacagcagcagttaagggcagaacttcgtttagaggcacttcatcagatcctcgttctattgtctgggatggaagaaaaaggtagcatctcactggcaggaagcagattgagttcaggcttccagtcctccacactactcacgtctgtgaggctgcagttcctagcagggtgttttggtttaggcactgttggacacacaggagccaagggagagagtggccgattgcatcactatcaggatgggatcagagcagctaagagaaatattcagattgaaatccaggtagctgtgcataaaatttatcaacagttgtctgctaccctggaaagagccctgcaagcaaacaagcatcacattgaagcccagcaacgtctgcttctggttacagtttttgccctaagtgttcattatcaaccagtagatgtttctttggcaatttccactggtctgctaaacgtattgtcacagttgtgtggtacagacaccatgctaggacagcccctgcagttgttgccaaagacgggtgtttcccagcttagcacagctttgaaagtggccagtacaaggttgctccagattctagccatcactactgggacctatgctgataaactgagtcccaaagtagttcaatccttgttggatctactctgtagtcagttgaagaatttattgtcccaaactggtgtactacatatggcctctttcggagaaggggagcaagaagacggtgaagaagaagaaaaaaaagttgactccagtggagaaactgagaagaaagatttcagagctgctcttaggaaacaacatgcagccgaactccatctaggggattttttagtttttcttcgcagagttgtatcttcaaaagcaattcaatcaaaaatggcttccccaaagtggaccgaagtgcttctaaatatagcatctcagaaatgttcttcaggtatccctctggttggtaacttaagaacaaggctccttgcacttcatgtccttgaagctgtgctgccagcttgtgaatctggtgtagaagatgatcaaatggcccagattgttgagcgcttattttcccttctctctgattgtatgtgggagacacccattgctcaggccaaacatgctattcagataaaggaaaaagaacaagaaataaaactacagaagcagggcgagttggaagaagaagatgagaatcttcctatccaagaagtatcctttgacccggagaaagctcagtgttgcctagtggagaatggacagattttaactcacggcagtggagggaaaggatatggattggcatctacaggagtaacttctgggtgctatcagtggaagttttatattgtgaaggaaaacagaggtaatgaaggcacgtgtgttggagtttctcgctggccagtacatgactttaatcaccgcactacctcggatatgtggctctatagggcctacagtggtaacctctatcacaatggagaacagactctcacattgtccagctttactcaaggagatttcattacctgtgtgttagacatggaagccaggaccatttcttttgggaaaaatggagaggaacccaaattagcttttgaagatgtggatgcagcagagttgtacccatgtgtgatgttctatagtagcaatccaggggaaaaggtgaaaatttgtgatatgcagatgcgtggcacaccccgagacttacttccaggagaccctatttgtagtccagtagcagcagtgctggctgaggccactattcagctcatccgtatccttcaccgaacagaccgttggacttactgcattaacaaaaaaatgatggaaaggcttcacaaaattaagatatgtattaaagagtcaggtcagaagctaaagaaaagccgctcggttcagagccgagaggaaaatgaaatgagagaggagaaggagagcaaagaggaagagaaaggtaaacatactaggcatggcctcgctgacctctcagagctgcagctgaggactctttgcatagaggtgtggcccgtgctggctgtgataggaggagttgatgctggtcttagagttggaggtcggtgtgttcacaagcaaactgggcgccatgccacgctgctgggagtggtcaaagagggcagcacgtctgccaaggtccaatgggatgaagcagaaattactatcagcttcccaactttttggtcgcctagtgatactccattgtataatctggaaccctgtgaaccattgccgtttgatgtggcgcgattccgaggcctgacggcttctgtgctgctggacctaacatatctcactggcgttcatgaagacatgggcaaacagagcaccaaacgacatgaaaagaaacaccgacatgaatccgaggagaaaggggatgttgagcagaaacctgagagtgaatccgctttagatatgcgaacaggcctaacatctgatgacgtcaaaagtcagagtaccacaagctccaaatcagaaaatgaaatcgcttcattttctttagatccaacactgccaagtgtggaatcccaacatcaaataacagaagggaaaagaaaaaatcatgaacacatgtccaaaaaccatgatgtagcccagtcagaaatcagagcagtccagctgtcctatctttacctcggtgctatgaagtcacttagtgcccttcttggctgtagtaaatatgctgagctgttgctgataccaaaagttctggctgaaaatggccacaactcagactgtgcaagttctccagttgttcatgaagacgtggagatgcgagcagccctgcagttcttgatgcgacacatggtgaagcgagcagtcatgcggtcacccataaagagagcattgggattagctgatctggaacgagcgcaagccatgatctataaattagtggttcatgggcttttggaagaccagtttgggggcaaaattaagcaagagattgatcaacaagctgaagaaagtgaccctgcccagcaggcacagacaccagttactactagcccatcagcctcaagcacgacctcctttatgagcagctctctggaggacaccacaactgccaccactccagtcactgacacagaaacagtgcctgcatccgagtccccgggagtgatgcctcttagtcttctcaggcaaatgttctctagttacccaactaccactgtacttcccacacgtcgggcacagactcctccaatatcttcgttaccaacctctccttctgatgaagtaggaaggaggcaaagtttaacttctcctgattcccagtcagcaaggccagctaaccgcacagccttgtcagacccaagcagtagactttcaacttctcctcctcctccagcaattgcagttcccttgctggaaatggggttctctcttcggcagattgccaaagccatggaagctacaggtgctaggggagaggctgatgcccagaatatcactgtccttgccatgtggatgatagagcaccctgggcatgaggatgaagaggagccccagtcgggcagcacagcagactctaggcctggagcagccgttctaggcagtggcgggaagtcaaatgatccctgttatttgcagtcacctggagacataccatcagctgatgctgctgaaatggaggaaggttttagtgaaagccctgataatttggatcatacagagaatgcagcttctggaagtggaccatcagctagaggtcgctcagcggtaacaagaagacacaagtttgacttagctgctcgcacactgctagcaagagcagcgggattataccgctctgtgcaggcccacaggaatcaaagtcggagagaaggaatatctttgcagcaagacccaggggcgttgtatgactttaatttagatgaggaattggaaattgatcttgatgatgaggcgatggaagctatgtttggacaagacctgaccagtgacaatgatattctgggaatgtggatcccagagcatgtttgtgagtctgaagacagggaagaagtggtggtgtgtgaactgtgtgaatgcagcgtcgtcagcttcaatcagcacatgaagagaaaccatccaggctgtgggcgcagtgcaaaccgccagggctatcgcagcaatggttcctatgtggatggctggtttggcggtgaatgtgggagtggaaatccatactacctgttatgtggcacctgcagggagaagtacttagccatgaagaccaaatctaagtcaacaagttctgaaaggtacaagggacaagctccagatctaattggcaagcaagacagtgtgtatgaagaagactgggacatgttggatgttgatgaagatgaaaagctaactggtgaagaagaatttgaattacttgctggaccgcttggtttaaatgaccggcgcattgtaccagaaccagttcagttccctgacagcgatccactgggagcatcagtagcaatggtcacagccaccaacagtatggaagagactctgatgcaaataggttgccatggctccgtagaaaagagctcctctgggagaataacgttaggagagcaggcagctgccctagcaaaccctcatgaccgtgtggtggctttaaggagagtgactgctgctgctcaggttcttctggccagaaccatggtcatgagagcgctgtctcttctctcagtcagtggttccagttgtagcctggctgctggtcttgagtctctggggctaacagatatccgaacgctagttcgattaatgtgcttggcagcagcagggagagctggcctctccaccagcccttctgccatggctagcacctcagaacgatcacgaggtgggcatagcaaggctaacaagcctatctcttgcctggcctatttgagcacagcagtgggatgtctggcatcaaatgctcctagtgctgccaaactgcttgtacagttgtgtacacagaacttgatttctgctgcaacaggtgtaaatctaaccacagttgatgactcaattcagcgaaagtttctacccagctttctccgaggaattgctgaagagaacaagcttgtgacctccccaaactttgttgtaacacaggcccttgtggcattgctagcagacaaaggggccaaactaagacctaactatgataagtcagaagttgaaaagaaaggccctctggagttggctaatgccctggcagcctgctgcctctcctccaggctgtcctcacagcatcggcaatgggcagctcagcaactcgtgcgcactcttgctgcacacgaccgtgacaaccaaactactctgcagacacttgctgatatgggaggagatcttagaaaatgctcctttatcaaattggaggctcatcagaacagagtaatgacatgtgtttggtgtaataaaaaaggtcttttggctacaagtggcaatgatggcaccatccgcgtatggaatgttaccaagaagcaatattcactgcaacagacctgtgtgttcaacagattggaaggggatgctgaggaaagcctgggatcacccagtgatccaagtttctcaccagtttcctggagtatcagtggcaaatatctagcaggcgctttggaaaagatggtgaatatctggcaagttaatggaggaaaaggattagtagatattcagcctcattgggtatctgccctggcttggccagaagagggtccggctacagcctggtcaggagagtctccagaattgttgttggtgggacggatggatggatctctgggactgattgaagttgttgatgtgtccaccatgcaccgtcgagaattggagcattgctatcgaaaggatgtgtctgttacttgcattgcatggttcagtgaagacagaccatttgcagtgggatattttgatggaaaactgttactgggaacaaaggaaccacttgagaaaggaggcattgttctaattgatgcacataaggatactcttattagcatgaagtgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctgcctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60549 - DNA, 9265 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccggcaagtaacttaaaactatcctcagacaaatatttgctctcatgatgtcagaaattaggtaacttttctattttggttcttcatttagatatcaacctggtaaacacttatcagaagtgtaccgttgtgtatacaaagttcgaagtcgtttacttgcttgcaagaaccttgaacttattcaaacaaggtcatcatcacgggacagatggatatcagaaaaccaggactctgcagatgttgatcctcaggagcattcatttactcgaactattgatgaagaagctgaaatggaagaacaggctgagagagaccgggaagaggggcatccggagccagaggatgaagaggaggaacgggaacatgaagtgatgacagctggcaaaatctttcagtgtttcctctcagcccgtgaagtagctcgtagccgagaccgagatagaatgaacagtggggcagggtctggggctcgagctgatgatccacctcctcagtctcagcaagagcgaagggtcagcacagaccttcctgagggtcaggatgtgtacactgctgcatgcaactccgtgatccatcggtgtgccctgttaatattaggagtaagtcctgtgatagatgagcttcagaagcgaagagaagaaggacagttgcagcaaccttcaacaagtgcctctgaagggggtggacttatgaccaggagtgaaagtcttactgcagagagccggctagtccacacaagcccaaattatagactgatcaaatcgaggagtgaatctgatttgtctcagcctgaatcagatgaagagggttacgcactgagtggcagacgaaatgttgatttggatttggcagcatctcacagaaagagaggtcctatgcacagtcaattggaatccctgagtgactcttgggctcgcctgaaacatagcagagactggttatgcaactcctcctattcctttgagtcagattttgatcttaccaagtctttgggagttcacactttgattgaaaatgttgtaagctttgtgagtggagatgtggggaattgggaccctacaggtcatattcttatgacatgtgccaaagaagacagtgtgaaactctggggctctatttcgggatgctggtgctgtctacattcactctgccatccatctattgtaaatggcattgcttggtgccgccttccagggaaaggatccaagttgcagttactgatggctactggctgtcagagtggcttagtatgtgtttggcgcattcctcaagatactacacagaccaatgtgactagtgcagaaggatggtgggaccaggaatcaaattgccaggatggatataggaaatcatcaggagccaagtgtgtttatcagctgcggggacacatcactcctgttcggactgttgcctttagttctgatgggttggccctggtgtctggtggactaggtgggctcatgaacatttggtctttaagggatggctctgtcttgcaaactgttgtgataggctctggagctattcagaccacagtatggattccagaagttggagtagctgcttgctcaaatagatcaaaggatgttttggtcgtgaattgtacagcagaatgggcagctgccaatcatgttttggcaacctgtaggacagcattgaaacagcagggtgttctgggattgaacatggctccctgcatgagagcatttttggagcggctccccatgatgcttcaggagcagtatgcctatgaaaagcctcatgtggtttgtggtgaccaacttgttcatagcccctatatgcaatgcttggcttcccttgctgtgggacttcatctggatcagctgttgtgtaaccctccagtgccaccacaccaccagaactgtctgcctgaccctgcatcctggaatccaaatgaatgggcctggttagaatgtttctcaaccactataaaagctgccgaagccctgaccaatggagcccagtttccagaatcttttaccgttccagatctagaacctgttccagaggatgaacttgtatttctaatggataacagtaaatggattaacggcatggatgaacaaattatgtcttgggcaacttccagacctgaggactggcacctgggaggtaaatgtgatgtctacttatggggtgctggtaggcatggacagctggcagaagctggaagaaatgtaatggtacctgcagcagctccctcattctcacaggcccaacaggtcatttgtggtcagaattgtacctttgtcatccaggccaatggcacagtgttggcttgtggggaaggaagttatggcagattaggacaaggaaattcagatgaccttcatgtgctgacagttatttcagccttacaaggctttgtggtgacccagctggtgacttcctgtggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcagatgtcttgtggcttcaagcactcagcagtggtcacttcagatggcaaactgttcacctttgggaatggtgactatggtcgtctgggtcttggaaatacctctaacaaaaaacttccagagagagtgactgcactggagggatatcagattggacaggtggcctgtggattaaaccacactttggcagtgtcagcagatggttccatggtgtgggcttttggagatggagactatggaaaactaggcttaggaaattccactgcaaaatcttcacctcagaaaattgacgtcctttgtggaattggaataaaaaaggttgcttgtggaactcagttttctgttgctttgaccaaagatggtcatgtgtatacctttggtcaagatcgcctgataggcttgccagaggggcgtgctcgcaatcacaatcgaccgcaacaaatccctgtcctggctggagtaatcattgaagatgtggcagttggagctgaacacacacttgctttggcatcaaatggagatgtgtatgcctgggggagcaattcagaagggcagctcggcttaggccataccaaccatgttcgagaaccaaccctggtaacaggtctgcaagggaaaaatgttcggcagatctcggctggccgctgccacagtgctgcatggacagcaccacctgtcccaccaagagcaccaggtgtgtcagtacctctgcagctgggcctgcctgacacagtgcccccccagtatggggcgctgagagaagtcagcattcacacggtgcgggccaggctccggctgctctaccacttctctgacctcatgtactcatcctggagactgctgaaccttagccccaacaaccagaacagcacatcccattataatgctggaacttggggcattgtacagggacaacttcggcctttgttagccccaagagtctacactctgccaatggtgcgctccataggaaaaaccatggttcaaggcaaaaactatggacctcagataactgtaaagaggatatcaaccagaggacggaagtgtaagcctatttttgtccaaatagcgagacaagtagttaagctgaatgcttcagacctccgcctgccttcccgagcgtggaaggttaagctggttggagaaggggctgatgatgctggaggagtgtttgatgacaccatcacagagatgtgccaggaacttgaaactggtattgttgaccttcttataccctctcccaatgccaccgcagaagtgggttacaatagggacaggttcctttttaacccttctgcctgcctcgatgaacacttaatgcagtttaagtttttaggaattttaatgggggttgccattcgcacaaagaagcctctggacctccacttggcccctctggtgtggaagcagctgtgctgtgtcccactcaccctagaggacctggaggaggtggatctgctctacgtgcagactctcaacagcattcttcacattgaagacagtgggattaccgaggagagtttccatgagatgattcctcttgattcttttgttggccagagtgctgatggcaaaatggttcctataatccctggtggaaatagtatcccactcacattttccaacaggaaggaatatgtggagagggccattgaatatcgacttcatgagatggacagacaggtggctgcagtccgagaagggatgtcctggattgttcctgtgccgctgctgtccctcctcacagcaaaacaactggagcagatggtgtgtgggatgcccgagatctctgtggaagtcttgaagaaagtggtgcggtaccgtgaggtggatgagcagcatcagctggtgcagtggttctggcacacgctggaagagttctccaatgaggagcgggtgcttttcatgaggtttgtgtcaggaagatctcgactaccagccaacactgctgacatttctcagagatttcaaatcatgaaggttgataggccttacgacagtctgcctacctcacagacctgcttcttccagctgaggctgcccccgtactccagccagctggtcatggccgagcgcctgcgctatgccatcaacaactgccgctcaatcgacatggacaactacatgctctcgagaaacgtggacaacgccgagggctccgacactgactactgaccgtgcgggtgctctcaccctcccttctctccctcaataatgctcacttctgatttgatgttgatatacttttatggtaactacatagatgttataagaacataaaccaacattataaacaatggccacatttagttactctaaatgtaacaaagaaattagatgtttttatttttctgtgattgtacaaaaacaacaaaaacgaagtgctctcagtcaggtttttccctccatatttttggtcacttttgataagtttgcatgaaaccattttggtgcatttttagttgggaatggtacatttttgtaaatccacccagtgaacatgaaattgtacattgtgtataattgttcattagaaaggacagttttacatgaatattcatatatttattttgttttaatttgaattgcctgttcagggttccttatgcagagaaataaagcagattcaggaattgg

SEQ ID NO: 60550 - DNA, 4336 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagagatgtgatatacgtctcagctgctggcagtatgctctgccagattgttaactccctgctgttactccctgtgtcagtggctcggcctttattgagttacctcctcgacttgttgccacctcttgattgccttaatagactcctgccagctgctgatcttttagaagaccaggagttacagtggcctcttcatggagggccagaactaattgatcctgctggtctgccattacctcagccagctcagtcctgggtatggcttgtggatctagaaagaacaattgctctccttattgggcggtgtcttggtggcatgcttcagggctcccctgtgtctccagaggaacaggacactgcatattggatgaaaacgccactgttcagtgacggtgtagaaatggacactcctcaattggataaatgtatgagttgcctgttagaagtagcactttctggaaatgaagaacagaagccttttgattataaattgcggcctgaaattgctgtctatgtagacttggcattgggttgttctaaagagcctgcccgaagcctttggatcagcatgcaggactatgctgttagtaaagattgggacagtgcaactttaagtaatgagtcactcttggacactgtgtctagatttgttcttgcagctcttctgaaacacacaaatttacttagtcaagcatgtggagaaagccgatatcaacctggtaaacacttatcagaagtgtaccgttgtgtatacaaagttcgaagtcgtttacttgcttgcaagaaccttgaacttattcaaacaaggtcatcatcacgggacagatgggtaaagtttgaaatcaattaatttctatgtttttctgcaagctgtgagagctagctctaaattggtttatgtgagaaaaaaatgtgccttggttattgcatatgttcaatacatgttgagtagttcttttcctagcagaaaaaaa

SEQ ID NO: 60551 - DNA, 3711 bp, Homo sapiens
gcagcaaaaataaaggacgcgaccgaattccgcctctgcggagccgggctcgggtcgccggagccgcgccccaccccgccagctccagagccacgtaaatggggtttcaccgtgttagccaggatggtctcaatctcctgacctcgtgatccgcccacctcggcctcccaaagtactgggattacaggactaatggctgaaggataaatcaacatggcaactatgattccaccagtgaagctgaaatggcttgaacacttgaacagctcctggattacagaggacagtgaatctattgctacaagagagggagttgctgttctgtattctaaactggttagcaataaggaagtagtacctttgccccaacaagttttatgcctcaaaggaccacagttgccagactttgaacgtgagtctctttcaagtgatgagcaggaccactatttggatgcccttcttagcagccagctagcattggcaaagatggtatgttcagattccccatttgccggggcacttagaaaacgactgcttgtactccagcgtgtcttttatgcactttctaataaataccatgacaaaggcaaggtgaagcagcagcagcattctccggagagcagttctggttcagcagatgtccattctgttagtgaacgcccccggtcaagcactgatgcacttatagaaatgggtgttcgaactggtctaagtttattatttgcgcttctaagacaaagttggatgatgcctgtgtcaggacctggtctcagtctttgcaacgatgtcattcatactgcaattgaagttgtgagctctttgccaccattatcattagcaaatgaaagcaagattcctcctatgggcttggactgcttatcgcaagtaacaacatttcttaaaggagtcactattcctaattctggggcagacactttaggtcgtagattagcttctgagttgctgcttggtttggcagctcaacgaggctcattgcgatatcttcttgaatggatagaaatggctttgggggcttcggcagttgtacacaccatggagaaaggcaaactactctcaagccaggaaggaatgatcagctttgactgctttatgaccatattaatgcagatgaggcgttctttgggttcatctgctgatcggagtcagtggagagaaccaaccagaacatcggatggcttgtgctccctttacgaggcagcattatgtctctttgaagaggtttgcagaatggcttctgattattcgagaacatgtgctagcccagatagcattcagactggtgatgctcccattgtctccgaaacctgtgaggtttatgtttgggggagcaatagcagccatcagttggtagaaggtacacaggagaaaatactgcaacccaaactggctcctagtttctctgatgcacagaccattgaagctggacagtactgcacttttgtcatttctacggatggctcagttagagcttgcgggaaaggcagctatgggagactgggccttggagactccaataatcagtcaactttaaaaaagttaacattcgagcctcacagatccattaaaaaggtttcatcttctaaaggatctgatggtcacactttagcctttacgacagaaggagaagtcttcagttggggagatggtgattatgggaaactggggcatggaaatagttcaacacagaaatatcccaagcttattcagggacctctacaaggaaaggtagttgtttgtgtgtcagctggatacagacatagtgctgctgtcacagaggatggggaattatacacatggggtgaaggagactttggaagattaggtcatggtgacagcaatagtcgtaacattccaacattagtaaaagacatcagcaatgtaggagaggtttcttgtggcagttcacatactattgctctgtctaaagatgggagaactgtatggtcttttggaggaggagacaatggtaaacttggtcatggtgataccaacagagtgtataaacctaaagttattgaagctttacaaggaatgttcattcgcaaagtttgtgctgggagccagtcttcacttgctttgacatcaacagggcaggtctatgcttggggctgtggagcttgtctaggttgtggttcttcagaagctactgctttgagacccaagcttattgaagaactggctgccacaagaatagttgatgtttctattggagacagtcattgtttggctctttctcatgataatgaagtttatgcctggggcaataactcaatggggcaatgtggtcagggaaattccacaggtcctattactaaaccaaagaaagtgagtggcttagatggcatagctattcagcagatttcggctggaacatcacatagtctggcatggactgctcttcctagggacagacaagttgttgcatggcaccgaccttattgtgtagatcttgaagagagtaccttctcacacctgcgttcttttcttgagagatactgtgataaaataaacagtgagattcccccactccctttcccttcatcaagagaacaccacagttttctcaagctgtgcctgaagctactttcaaatcaccttgctcttgcacttgcgggaggggtagctaccagcattctcgggaggcaggcaggtccacttcgaaatttgctcttcagactgatggactcaactgtcccagatgaaatccaagaggtggtaattgaaactttatcagtgggagcaaccatgctgttacctccattacgagaacggatggaattacttcattctcttttacctcaaggacctgatagatgggaaagcttatctaaaggacagagaatgcaactggatatcatcctgacaagtttgcaagatcatacccacgtagcctccctacttggctatagttcaccctctgatgctgctgacctatcttctgtgtgtactggctacggaaatctgtcagatcaaccttacggcactcagagctgccatccagatacccacctggctgaaattttgatgaagaccctcttaagaaatttaggattttatacagatcaagcatttggagagctagaaaagaatagtgataaatttctacttggaacatcatcatcagaaaacagtcagcctgctcatcttcatgaactgctatgttcactacagaaacagctgctggcattttgccatatcaataacattagtgagaactcaagcagtgtggcattgcttcataaacatcttcagcttttgttgcctcatgccacagatatttattcacgttctgcaaatttgctcaaagaaagtccttggaatggcagtgttggagaaaaattaagaggtgagtttggtatttcatttcaaatttaatcagtcattaagaagtaagaacacttggctttccaaagtcttaagagagccagaagcctctggaataggaatggtcttgaatttccttctattgaagattcctttagtcttggtttgggggtagtgttagcagtgattggtcttagaaagagtctacttggcatgacagaggcctaatttaaaggcactggatgatataaactcaaaaatattaattttaaatggcagaaagtgagattttttaatctgctctttttttttttttttaaaacggatttgcactctagcctgggcaacaagagtgaaaatccgtct

SEQ ID NO: 60552 - DNA, 629 bp, Homo sapiens
ggttctgatgggcactctatggccctaactgaaagtggtgaggtctttagctggggagatggtgactatggtaaacttggccatgggaacagcgacaggcagcggcggcccaggcagatcgaggccttacaaggagaagaagtggtgcaggtcaggcaggaaatggataagtttgcctttcattgtaaatatactagttgttgaataggtttcttaaaattaggtaacagaaaatatagtaaaaatatattacacagtaattataagagatccattggttttggatgttcagattcattcttgagcttgtcagaagtttgaataggctttggtgttagtattggtcttgttagtattggttagaatggtctttttcgtgagccagctggttggcccagactagggtgctgcacgcccttggaaggaatattgtgtggtttaacttctgccacacagttcttaatacacagataaaaggaaaactttgcttttaacctatcatttatgttacaaaagctaagttaacatgcattttctggaaaatagtgttctaaaatcatattgtaagattgtatagcaccttatagtttacaaacaatttccccatttattatctcatttagtctagg

SEQ ID NO: 60553 - DNA, 231 bp, Homo sapiens
actacggaaatataccaaatccgtaatccagccagggaataaataccttgacctcatttcttccaaacctctgatcttatgtaggtactgtgcattggcaggacccaagaaggtagagggcaagagagtttactgatgcagttcattcaggctagcactcagggacacagaacatggagaccaatggagagtagttctaacagggcagacagaaaatatgtagcacaaatt

SEQ ID NO: 60554 - DNA, 419 bp, Homo sapiens
cagctccccaccataccatctctcctcttaggccagcttcccaatgggtgtctgcaggcattccactcactcctatatcctctgtttcaaagaccttctcctttcctctcttccaatcttacacatccacaaagccccaacataataaaaatgataggtatctcctgttaaatacttgactggtttcagatctgtctaatgaaacgggttctatcattattctccctttacagatgaggaaactgaggtgcaaagcagttaagcaactggtccaagatctagaccaggtactcaaccaccccactccacatgcaactgtccccaacccatgcgattcatcctttccctgaaggcttgtgtggtgctgccttttaaattcataacataatgacttcattgttatgaaattcttttctgtg

SEQ ID NO: 60555 - DNA, 227 bp, Homo sapiens
ggtaaaaataagtaaatggtggtcttaaactgtatttatggcattatttctcactattcctttacagatcccctatatataggtaaaactcattagtccttattttctatttccttttatcctccctttaaagtcattgtctttacctggaacactaactctccaatctacctatcaaattctactcaaaatcttcaatgtctacatcagatgtcatgtaacctatt

SEQ ID NO: 60556 - DNA, 1023 bp, Homo sapiens
ggccagaatgttccttgctgcagatgcattggccccatctgcaggtcctctttgacacctaccttactctctccctccactcacactctgagaactgtgctcaggggcagcgctacaacttccacattggtctttacagggcttgagtgattatttcaagaacagaacgctgtgtggaaacctttaccatatttcgttgtatctaagacacattttttttttttgaaatttaacatctctaaggttgggttatgtttcttcatcattgtcaggttggagcttaatcagcagcacttttttttaatgtcacacacagtaatggtgatgcatctcacaattgagatcatcttagacatgatggaatatggaatcgtgtgcctgttacaagccaggctcttggtctgggttctagagacggtggaaaccaagacagcaccatcctctagtggtgttcacatcccaccacagtggagtcaggactttgaagtcctccattggatcttctcggaagatgagggaaatgagagagtgtggagagagattttgtaagtccggtctggaagtggtcattgttcagaatccagccacgtgggtacatggaactgtaaggctatttcaacatgggaaactgaaatcgggcatatccctgcggaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcaagaaaccatttgataaacac

SEQ ID NO: 60557 - DNA, 442 bp, Homo sapiens
aatcccaggccagagatcttggatgcaggctatttcaacatgggaaactgaaatcgggcatatccctgcggaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcaagaaaccatttgataaacac

SEQ ID NO: 60558 - DNA, 481 bp, Homo sapiens
aaccagagttcgtaattctaatgacctctccagatttatggctgcagcattcccaagaaggggtagggaggggcatataatgagctaccctcaggggatcagaaagaaaagggaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcaagaaaccatttgataaacac

SEQ ID NO: 60559 - DNA, 443 bp, Homo sapiens
gatgagcaggtgagaccaggtaattaccgaagaaagagagtgatgtgttcattgaagtctactcatggaggaaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcaagaaaccatttgataaacac

SEQ ID NO: 60560 - DNA, 676 bp, Homo sapiens
gacacactctcctgccttatggaagactttgcatcagcatgacgagaagtggtggctgatgactccaaggcaccctaggctgtgatcctggaactgaacatctgatgagtcaatacagggcacggagtaggactttgaagtcctccattggatcttctcggaagatgagggaaatgagagagtgtggagagagattttgtaagtccggtctggaagtggtcattgttcagaatccagccacgtgggtacatggaactgtaaggctatttcaacatgggaaactgaaatcgggcatatccctgcggaagaagctgtcccttagcgaagaataaaactgtggactgacccccacccatttgcgaagaaagtactgggtcttcagctttcattgttcagccggtggtctttgtggacaacaccaggggcccctcctgctgaagactgtctggacttcctgattttcactcctgtataaaccccctcccccattactacctttgtctccttggggaaaaaaaatgtttttcacttaagcaaaataataactacccagtatttgtttctggagtgaaattgtaaacttcattgtacattcttcctggctttgatgcttatcgtgaagagttcagtgaaaataaattgtttttatgaaagcaagaaaccatttgataaacac

SEQ ID NO: 60561 - DNA, 359 bp, Homo sapiens
agaatcaaacattggattccggaaatagcatgactatgaatggtgagaagttctaagttcacctgcctctctattcctcttacccatgaaactgatatgaactgttgataagctcatatcaatttcaagtaataaagctgaatacagcagtgggtcacagacaacatttccttcatctgcttgtgctggagaggctgtgtgtggggcaaaccaacagggagaggccagcctgcaggcatctgaagaagttgaaagtgtccacaagtacaagctcaagtttaacataggaattttttacaaacatacatgtctcctgttaaatgtgtgcaactatctgattaaaaccaaattgagcatta

SEQ ID NO: 60562 - DNA, 636 bp, Homo sapiens
atgacttgagctgagatgtgcagagggggttggagagacgggcgagacgacatcagggaaggccttgtttgtcaggttaaaatgtttcctctttatgtgataacagactccctcttttatctggcagctgctccctcaagaggaatacccattctttcttcctaggtcaagaaagagagtccaaggcatggtcaatcacaacactgtccctctagtcatgggccaagtgctgggcacacgtcaccagccaggctactcttagcctttcccataattttaataacctgagactgggagaaagaagcctcactctctcctggagtgatcaaactgtatgtaagtctagagttctctgtgagtacagtctcctctagcaagaaaggatgagaccaactcataataagaagccaaaatacatgtacatatgagtaagagagagagagagagctgacagcattgtttgggtgtctggatctagccattcctgtggtggctctgtctagtccttacttaaatgagttaatacatccccttttaactgaagctagtttgtgttgggtttctgtcccttaaagtcaagagtcctgagaaatacaatactggtcaaaaaaagtcttcatagaacaggtgaaccag

SEQ ID NO: 60563 - DNA, 354 bp, Homo sapiens
accataatggtacttacctcgttatacggttgttgtattaaatgagttctatgtagaacacagtgccagccccacaggaaatgttcattattctatcacgacaccttctcacctgcagaaacctagagcagggagggaggtaatctttatgtacattttctcttgctagatgcatttccatccagttaccacagcaatgggagagggctgcagtagtttgaaaacacttcgaaattggccgagcgcggtggctcacgcctgtaatcccagcactttgggaggccgaggcgggtggatcacgaggtcaggagagcgagaccatcctggctaacacggtgaaaccccgtctttact

SEQ ID NO: 60564 - DNA, 1607 bp, Homo sapiens
agctcggtacccgagtgttcttagtagagacggggttttccatggttggtcaggctgttcttggactaccgacctcatgtgatcggcccacctcagcctcccgagtatctgggatcaaggtgcatacccaccacacctggctaattttgtttattttttgtagagacagggtctcactatgttgcccaggttgatctcaaactcctgggctcaagcgatcctcccaccttagcctcccaaagtactgggattataggtgtgagccacagtgcctggcctaattattttcttgtgatcaaattcaggtttaatgtttttggttaagaatttcctacgtgaattcgtgtacttattttgtcatttagagttcataaatattagggtttattttctaaatagaatagtttaaactaaatataacttcaaaacgtctagtttgagtagctaccgttgtttggattgaaattttctgatactgaaaagaacaaaaagcctgcctttctgcccagaaccttttgcctcccccagtcagttcttggagcagcactagttaggggcccagagttcggccttctgtgtggtgattttacgctctgcctaaacaaggagcctacatcttttagctcctattccacccttctcacacgtttttgttgttgtttggttgtttttttttgagacagagtctcactctgttgcccaggctggagtgcagtggcacaatctcggctcattgcaacctccgcctcccgcgttcaagtgattctcttgcctcagcctcccaagtaactgatattacaggcgcccagccaccacaccccgctgatttttgtatttttagtagagacggggttttcccacgttggccgggctggtctcaaactcttgacctcaagtgaaccacccgcctgtgcctcccaaagtgctggaattaccagcgtgagccaccatgccgggctcacacgtttgagttgataccattgtgccattcctcttttggcctcttttttgtccatagaggcttcaagatagataggtaagagcccagtagtgttcataagaagccaatagagagcaggagccactttatcaggtggcaggtgtcctgggcctccctgctggctagtcccaagcggtggtgttgccaggatgtcttggaggtgataatgggacacacagaggcactgagtctccataggttaaaatgccaccaaaactggcctttgcctaatatccctcattgactatttagcatttaatttatttattttcctgacatttctgcaagctttgtatttatatttccactttatagatgaggaaatttgaggctcttagaggtaaaatgacttgcccaggtcacacaggaagtggcagagacaagctttttaaataagaaaaaattaataaaatataatatgagagtaacttaaaatattaataaaccacaattttaaattaattaaccgtgataaccaacattaataaaagttaagataccaaaacactggtgtctaattctttcaactaacaacttgaattattttccattttaaattaattaaccgtgataaccaacattaataaaagttaagataccaaaacac

SEQ ID NO: 60565 - DNA, 701 bp, Homo sapiens
aaaatttaaaccaaagttccagcatcattgattaagtaatttatcctttcccacagacctgttgtgctggctaggttcaccttttccccagtgatcttctacttgccctcacacatgttagaattctatactatatcagcctcttggcttccattggctgttcacacccactggtattttattatttatattgctttataataacctttgatatatagtaggacaagcctcaccattttactcttctccttcaaagtgtcttattcttagtctgcactttcacatgttccattcctctctaccctaaatgggattttgaatgaaagggtattgaaattattgattcgtaaatgattggcatctttatgtaactgggacgttctattcattaatacagcatatggatcaatttatttaggtgtttgatatcttccaacacagttttataaagtgctacatttagatgtaacacatctcttatagttccttatttttgttaatacttcaagtggtatctttttattacattttctatcaacagttactggtatataatgatacaattattaaatatatctgtattcattcgtttgctaaagtttctgttataatttgtttttacattattttggaattttccatatagaattgtatattatctttaaaaaataaaatagaattggcaaaactgaaaaaaaact

SEQ ID NO: 60566 - DNA, 685 bp, Homo sapiens
gtagagtattgtattcaaacaacctacataaaataacatttctcatcaccacacatacacacaatggcatcgtgcttctgtgtcctggctacatgtagcactctctgatttttcttaattcagttgagttttttttttttccaagtgttcatcttgatccactaaatttattgcatgacctatgaaatggatcataacccaaattctgaaacaaccatcctgagaaataagtggtggtggtggtaccctgcagccattttccataattggcaaggatgattcctccgatcagctcaaatatctgttgccaaactattgtttatatacatttgaaacatgtacatttagacaaatggcaagactaaggacaacagataggtgttttcacttggtaaatataactcaaattgtcttttcaaataaaaagatatattaaaaatcgttcagcttttaaagtagtaatcatattctttttatgtttatgtggttaaaagtgattccctatcattttgaggtcgaaagggttgcctgatagttggtgcaatgttttaaataaactgcttccatatattatctcatttgatcttcaaaatagtagacaaaagatgcacactcctactggtaacattaaaactcccactttctgacctctattttagtgatccacagtgttccaatgagaagc

SEQ ID NO: 60567 - DNA, 274 bp, Homo sapiens
agaggacaacttttctgatgaatcagaactggaagtgattaagggctcagtgcattaaaacaacgagcactcacgtccatttctccatttcataggaaaatcaaacattgtcttttaagtaagtggaggccgcttaaccaaactctttaagtgagccatagataagtgcattggcatggtttgaggaaatgcatagaggaaattaaaaatatttattttatcgaactaatagctgtccccgctggagattgaagtaattgagcccgtaactaca

SEQ ID NO: 60568 - DNA, 229 bp, Homo sapiens
ctctgggccaagcactaatgtgagtctccatcctcacacagtagccatggggttcttccacagctagtgctctccttgtggtccttctgtggctctctctcacctacaacacaagccagactctacataggctggcccccggccctgcctcatttacctctagtttcacctttgaaagggatgtcctgcctttaccgtgggtacttggagctccctctgcttggaatgc

SEQ ID NO: 60569 - DNA, 348 bp, Homo sapiens
cttacaaacaaggttcaagtcaggagaaaaaaattaattgaaagcaagaagacttttgttcaaaagatatattcaataattgatattgttaatgaagtaagtactttttaaggtatgaaagaactaaaaggtattccagactcagaaccttaaagttctaggcaagaataatttttaaactaaaggtaagtttataaattaacaaagtaaacaaaatttatgattttgttttttgtttgtaatttttgtttaattttaaaggtaagtttataaattaacaaacaaaatttataattttttgtttgtaatttttgtttataaacaaaataaattttttgtaacttgtta

SEQ ID NO: 60570 - DNA, 615 bp, Homo sapiens
ccgatcactcgcctctcgccggacgtgggcaacccgaatgcggtgggactgcatttctcctcatccttccattggctccccacggaccccccagaaactcctgacctctaccgtgcaattcacgggagctgcccgggcacggaaagcaaaatcagcttggagaaacacttctcaagcctgcaagacccggtggcacgttcattcttgcattgattggttcgtaccctgtgtactgagcgcttagccctgtactccggctccttttgaggccctgtacttaagctcaatagtaccaacaacagctgagagtttgcggtctagtggggaaggaaaatgcagaaccaaccaactaggtgtgatactatgtggttaagtgacatgcagaagacgtccccagaacagcataaaaggaacatttggttaggcctggggtcagcttcacagaggtaacaacggacggtgaacagctcaagcaaaggtccaacagcatgatccaagcctttgtcaatgttttgtaatctcgtttacttgcctgtaattcaagagggaaccatgtcttcttaaaccctgaagccacaattggcaggcctcaaggatatttgcagaatgatggtg

SEQ ID NO: 60571 - DNA, 799 bp, Homo sapiens
gcgggagcggagagcggacccagagagccctgagcagccccaccgccgccgccggcctagttaccatcacaccccgggaggagccgcagctgccgcagccggccccagtcaccatcaccgcaaccatgagcagcgaggccgagacccagcagccgcccgcgacccacccgcgccccgccctcagcgccgcacgacaccaagcccggcactacgggcagcggcgcagggagcggtggcccgggcggcctcacatcggcggcgcctgccggcgggcacaaaaaggtcatcgcaacgaaggttttgggaacggtaaaatggttcaatgtaaggaacggatatggtttcatccacaggaacgacaccaaggaagatgtatttgtacaccagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagatgagacccaaggtcagcagccacctcaacgtcggtaccgccgcaacttcaattaccgacgccgacgcccagaaaaccctaaac

SEQ ID NO: 60572 - DNA, 169 bp, Homo sapiens
gtcgaccacagtattccaaccctcctgtgcagggagaagtgatggagggtgctgacaaccagggtgcaggagaacaaggtagaccagtgaggcagaatatgtatcggggatatagaccacgattccgcagaggccctcctctccaaagacagcctagagaggacggcaa

SEQ ID NO: 60573 - DNA, 326 bp, Homo sapiens
gtttaaaaactgtccaaatgtcattttaatttatgaaggcacccagaataagttctaatctcatactgccccaatatatttactgaagccaattctctcttttattaatttttactgaaaatagcacttttttcctccccctgatagtactgggtaatgttagaatgtcctctaaaattctttggacctcatttacattctcaagagatttttttaaatttaccaataagatgtgctatttgaggaattagactttagttcagttgtacatggattatgtctgctcatatcattcatgtctgagtctttcattttattaatatgtg

SEQ ID NO: 60574 - DNA, 91 bp, Homo sapiens
  misc_feature (21)..(21): n is a, c, g, or t
cattgtccagatatgaaccanggtttggccttttcacccagagaaaaaggacaggctcatgggtacactgtgctgggatgacgggcacaaa

SEQ ID NO: 60575 - DNA, 407 bp, Homo sapiens
cgagcaaaacacagaggactgcacctctagtggctcgtaatgagaaagaagatggtctcaaacctgagaaagataatgtggagtggacctctgttgtctcagtattaacagtcccttctaggaagtaggtagcatttctgaaaatagagtgaagcaattgactgatggatttaatctttaaactgcttaggtaaccatcaatctgtaatgagcttaatactcttaactaggtgctatttttcatgtgtgctactttgccagtgataaaggattacgaaaaattctttaccagaggaaaaaaaaaattgaatgacctttcttggaaggtggtcccttgtttgtgatcaaactttgacaagaactggtaattaattcctctaagaaattaacgttctcatagtgtgttt

SEQ ID NO: 60576 - DNA, 1451 bp, Homo sapiens
gtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtaagagtttatgacttctgtttgtgacgaacgaagatgaagtcttctcaagtacttagcatttcaaaggcagtgagcataattcagtttgggaaatcaagaggaaaaccatctggacaggcaggaaggatgaagggaattgtaaataaagaaaacaggattatgggaatccaaacaatatt

SEQ ID NO: 60577 - DNA, 1314 bp, Homo sapiens
cacgtgagaaaggatgtgtttgcttccccttctgccgtgattgtttcctgaggcctcccccgccatgctgaactgcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctga

SEQ ID NO: 60578 - DNA, 2155 bp, Homo sapiens
gtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggagcggtggatgattggataaactacttcagagcagaagagtatttaatgaactattcacagagaagatgaaacacagtgaactgtgcctcttaatccattctgagtgtaataagaaattttacccatcctccttcaaacataaaggtgagacgggaaagtgggctggagttgagcagagttcagagttctcctagctaggggcatactctggagtacgcaaatccaacagtcctgacagaggaaagcagcttcctgtatagttgacctggaaggtcaacttcttgtcagagttttacatgaattatttttatggtggaaatagatgtaaatgttccaccaaaaatgatttttatcaggaactgtcacagccacctcaaccttcagcaaccaccactgttcaaggcaacatccttcagcagcagaaagattgactcgctgtaggctcagacatggggcctcactatgtttcacaggctggtctaaaactcctgagctccagggatctgcctgcctccgcttcccaaagtggtgggattgtaggcatgagccatcatgcctggcctgctgtgagttttaaataaaaatgtaaatgctcttctccattttcttacctctccttttaaagtgtgtgtgtgtgtgtgttttttttaatgtcatataagtaatacgtattcgtggtagaaatatttttttaaaaaatagaagcaaaaaagtcacaatcatcctaattatcactatttgtagataatcactacattttgacacatataattctagagttttacctatataaatgatacacttattactatctgtaggcactatgttaagcattttatattatctttgtttttctttctaatggctttataaaatttggtttg

SEQ ID NO: 60579 - DNA, 1577 bp, Homo sapiens
gtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggttttggtatcaggatgatgctggcctcataaaatgagcagctggtgaccaggactgagaacttgtcccaggccacgagcctccccattgagaaggcaagcagactcacagttttttggcatctcagggatgctgcagcagtgacctagttctttcaaagggtctgtggattctcttgactttcctgatatgttcctgcagtagttctgggagccaaagttcacaatgtgagtctccacatgctgctctgtctgtctaagtggaagctacaaactagtcttgcttcctatctgccattttcactcaat

SEQ ID NO: 60580 - DNA, 1038 bp, Homo sapiens
tctaaatcaactgagacaagtttctgcctaggatgccttgatgtgttgatactcacaggatgcaatctccctcctttgtcaagtgaatacactaaggatgttggatccaaaagtcagttagtgacagctaatcccagcataattcggcaaaggagcggtggatgattggataaactacttcagagcagaagagtatttaatgaactattcacagagaagatgaaacacagtgaactgtgcctcttaatccattctgagtgtaataagaaattttacccatcctccttcaaacataaaggtgagacgggaaagtgggctggagttgagcagagttcagagttctcctagctaggggcatactctggagtacgcaaatccaacagtcctgacagaggaaagcagcttcctgtatagttgacctggaaggtcaacttcttgtcagagttttacatgaattatttttatggtggaaatagatgtaaatgttccaccaaaaatgatttttatcaggaactgtcacagccacctcaaccttcagcaaccaccactgttcaaggcaacatccttcagcagcagaaagattgactcgctgtaggctcagacatggggcctcactatgtttcacaggctggtctaaaactcctgagctccagggatctgcctgcctccgcttcccaaagtggtgggattgtaggcatgagccatcatgcctggcctgctgtgagttttaaataaaaatgtaaatgctcttctccattttcttacctctccttttaaagtgtgtgtgtgtgtgtgttttttttaatgtcatataagtaatacgtattcgtggtagaaatatttttttaaaaaatagaagcaaaaaagtcacaatcatcctaattatcactatttgtagataatcactacattttgacacatataattctagagttttacctatataaatgatacacttattactatctgtaggcactatgttaagcattttatattatctttgtttttctttctaatggctttataaaatttggtttg

SEQ ID NO: 60581 - DNA, 404 bp, Homo sapiens
ttccctagcaaacaccttctactatgtgcatggccaattggagaggaaaaaaataaatgttgttatatttaaatgcacttcagggaggctttttaaaaattttgctttttaaatttcaaggcaacagactagtttgttccttacaaacttcttggcatctttcttttcacatgctcttttttgctggactcagtcttcagtcaaattcctccaaagggtctgctgtaaacaatgattttgtgagcggttgtgtgttctttgcagtgaaaacccgccttgttttctgttgctagggcaaccccattccagctgccattgaagaaatgcgcggtggtgggaaatggtgggattctgaagaagagtggctgtggccgtcaaatagatgaagcaaattttgtcatgcg

SEQ ID NO: 60582 - DNA, 2306 bp, Homo sapiens
gtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctga

SEQ ID NO: 60583 - DNA, 2660 bp, Homo sapiens
  misc_feature (2655)..(2658): n is a, c, g, or t
  misc_feature (2660)..(2660): n is a, c, g, or t
gtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataattgtgatttgttgagccacgtctatattaactatagctcccctctatttttaaaattttacataaaattgcttcttcctcttttgtcaagtccacagagacaatgtgaagcattattgaatttagactgtgttgcttcatagtctggataacaggagccactttccttcctcagaatttaggacataaacccaattttaggtctgcattatgtaagcctgtttgcattgtcatttttattttagtgcaaaagactaccaatatgagtgaattatttgtttgtaaattggcataattgtcttcataatttaatgttcagaaatgcagtaaagcacgttgatgaaaannnnan

SEQ ID NO: 60584 - DNA, 1294 bp, Homo sapiens
gagagagtaagttgaattgtcaatggtgaatgagtataaaaactccccgtcatagcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctga

SEQ ID NO: 60585 - DNA, 1140 bp, Homo sapiens
  misc_feature (1110)..(1110): n is a, c, g, or t
gtccggggcgcagcggaaggctgcggcgcgccgctgaattaactgatgagagcgagttcttttcttctccgggaggggtggggagcgagggtcccggcgggcgaggcggaggagcccggggcaggatagcggtcccgggccgccgtggaaatttccaaggacttggtgcggcgcagagagcgcgtctcggggcggggtgggggggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacagcaaccccattccagctgccattgaagagacacacataaaccaangaatttggaaaggctaaaaataaaggggat

SEQ ID NO: 60586 - DNA, 378 bp, Homo sapiens
gaaggttttttcctatcagggattggattgattcaggcacaaagataatttgggcaccactggagttgggcataggcagttctgtgcaggatgcttcacaatagtatttcaacagatatagtgatctcggcttctgattttgttacataaaaacacattgattcagaaaaggacaaaagcaatgtaggtccacaaagattaaaacatcactaggccgggtgcagtggctcacgcccggtgagcacatcatgcccggtgagcacatcatgcccggtgatgtaatcccagcactttgggaggccaaggcagtcagatcatgaggtcaggagatcgagagcatcctggccaacatggtgaaaccctgtctctaccaaaata

SEQ ID NO: 60587 - DNA, 580 bp, Homo sapiens
gatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagcgtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaa

SEQ ID NO: 60588 - DNA, 666 bp, Homo sapiens
tagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaa

SEQ ID NO: 60589 - DNA, 371 bp, Homo sapiens
taagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggagggagaatcacttgaacccaggaggctggggttgcagtgagccgagactgcaccactgcactccagcctggccaatagagggagactccgtctcaaaaaaaaaaaaaataggagtttgaggccatgttcacacatcactgcagtccagtctggtaaacaaagcaaccccctgagtctttaaca

SEQ ID NO: 60590 - DNA, 764 bp, Homo sapiens
ctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagccc

SEQ ID NO: 60591 - DNA, 467 bp, Homo sapiens
cagcatttaggactgttatgttctcttgaggagctgactgctcataatgaccccattatgaaatgaccctctttattgcaggtaatattttttgctctgaaatctactttatctgataatatctaactatcttttgattagtgttagcatagtaaatctttttccattattttacttttaacttatttctgagtttatatttcaagtatgtttctccaaggtaacatatagttgggtctttctttcttatccaatctgagaatctctgttttttaattgggatatttagattatttacatttaatgtgattattggtgtataagtttaagtctatcatcttgtgacttgctttctattcgtcccatctgttctttatttaccttttctctgtctcttgtattatttttaatgcttcaattttatctcctttgttagcctattaggaataactccttgtagtattttc

SEQ ID NO: 60592 - DNA, 336 bp, Homo sapiens
atagtggttattacattctttagcccagtagccattaaattccttgtgcccttaaaacctaaaagttcacagggagaagacctcttactgacttgtagaatctcaatactacttatcttgaaatttcagtaagtgttaggtaaaagagttcatttgggataatcacactatgatagtctttagcttttgaattggaatccaaattttagtttagaacagcaaagtttgcgcctaaagatttcatgaagtaaaaatactaattgtgattatatatctaaatatttgcacatctaaagttgtcttttacccgtaaccagaataaatgataccttttta

SEQ ID NO: 60593 - DNA, 129 bp, Homo sapiens
gacccagcagatgttagatgctgtcacttctgagcccccaacagcaaagagcgcacctgaagaagtatcaggacaagaacaagaggttttttcaaaatagtaaaattaaaattaatttagttgaagtga

SEQ ID NO: 60594 - DNA, 354 bp, Homo sapiens
tgagagggggtcttgctatattgcccaggctagtctcaaactcctgggctcaagtgatccacccaccatagcctctggagcagttgggactccaggtgtgcagccatgtcctgcccagtcattttctttctgtgagcaatccagggcacttagaggaagatattccaaatcatggtctttgtagaattcattcctgcaaaatgccaatggcagcagccacttgatcctgtggtcattaattactctcaagcacaggtaactagttatgcctaatcaggatgctcctatgggcctgggaggactagctcctcctcccagcagggaggtcagcaccatgcttgggccctagtcaca

SEQ ID NO: 60595 - DNA, 213 bp, Homo sapiens
tcaaaaactcaatataatatgtaaatcaggggtgtccaatcttttggcttccctaggccatactggtgttaggccacattcaaagctatcctaggccacatgtggctggtgggccatgggttggacaagcttgatgtaaataaaaccaccagtggaaagagtttgttgtgagttacattcaaatacaacagttagtaaaacatcagaatagta

SEQ ID NO: 60596 - DNA, 235 bp, Homo sapiens
caagcttacaagaaccagagttgtttttacttttttcttgacttttatctacacaaggtatctgaagactcaaagagtcgcaaagttttggctgtctcacttttggtgtagctttggaggaagagggtcgttcagtaactgctggagtacagaaagtcgtttgtagtcttggcctctctttttgaatagtcatatgttgtaatcgttctagttccagtaaacgagttatcaagtg

SEQ ID NO: 60597 - DNA, 841 bp, Homo sapiens
ttgctgcgtgaacccagatctcagactagtcatccagccccattatgtaggactcagacacccctgtccacatctaacctccagccctaacgccacattagaaatgggggtcttactgctgctgtcactcctagtcaccctgttaaattctataccggtttacccaagtcgcccagagactgggccccacttacataagctgaagagaccagctgctttaatagcctcattacctaggatataggatcactgtccaacctcactccacagtgggcaagtttttacttcagaataacttttgaaataaatttccccggaacagctcgcccctctcaacaggactctgaggctccactacgttgctgttattcctgacagagtgatgaaaggaaatttaaacaagtggcattttgtaaaaccaccccagcctgtgtgactttcaatgcctgtccgatttggctgggaaaatattttagatccccagggctacatactgttttttataccctcctctttgtgtcagtgatggaaaaggtgtcaatctgctctgaatctctctgaacacctcaggaaataggcttttggctcgcagagaggggatgagaaatagttttgaaccaccaagtctcttggagggtgtcagcagccccttgaagtaaaagtgtggctgcaaacccagctctctgcattagccaggtgaacctgagcatgctgcatacaccctcagtcttggtttcttaatatgtaaaatgggaatgaatatgcgcacctcgtggggtggttgtgattaaaggcattcattataaagagcttagtttcatacaaagtgaaaaaaaaaaaa

SEQ ID NO: 60598 - DNA, 727 bp, Homo sapiens
  misc_feature (457)..(457): n is a, c, g, or t
  misc_feature (604)..(604): n is a, c, g, or t
  misc_feature (642)..(642): n is a, c, g, or t
  misc_feature (668)..(669): n is a, c, g, or t
  misc_feature (707)..(707): n is a, c, g, or t
atatgagaagtttatcctcaagaagacagcagtgggtatttgcattaagaagtggcagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaagggaagtccttaggcatgatttttgagaaaagaagtactcgaacaagattgtctacagaaacaggctttgcacttctgggaggacnatccttgtttcttaccacacaagatattcatttgggtgtgaatgaaagtctcacggacacggcccgtgtattgtctagcatggcagatgcagtattggctcgagtgtataaacaatcagatttggacaccctggctaaagaagcatncatccccaatatcaatgggctgtcagaattgtaccatnctatccagatcctggctgattacctnnacgctcaggaacactatagctctctgaaaggtcttacnctcagctggatcggggatgg

SEQ ID NO: 60599 - DNA, 673 bp, Homo sapiens
  misc_feature (403)..(403): n is a, c, g, or t
  misc_feature (550)..(550): n is a, c, g, or t
  misc_feature (588)..(588): n is a, c, g, or t
  misc_feature (614)..(615): n is a, c, g, or t
  misc_feature (653)..(653): n is a, c, g, or t
atatgagaagtttatcctcaagaagacagcagtgggtatttgcattaagaagtggcagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaagggaagtccttaggcatgatttttgagggacnatccttgtttcttaccacacaagatattcatttgggtgtgaatgaaagtctcacggacacggcccgtgtattgtctagcatggcagatgcagtattggctcgagtgtataaacaatcagatttggacaccctggctaaagaagcatncatccccaatatcaatgggctgtcagaattgtaccatnctatccagatcctggctgattacctnnacgctcaggaacactatagctctctgaaaggtcttacnctcagctggatcggggatgg

SEQ ID NO: 60600 - DNA, 312 bp, Homo sapiens
ttggctagaagggaggctggagcctttcatggtggcttttgaatgccatggtgaatagtttgtgctttatttgttattgaatagcaatttgtacacttctgagctattagagtgaaatgattaagcctgtggtttaggaagaaagagcctattagggagataaatctttccctagttgtaggaagggttggaacagtatgatatggagagggtagtaatgaatgaaggaatggaaaacgagaataatttcaatgatactggaggtgcagtatacaagttggcagtagttttatgtctaggaagataagaagt

SEQ ID NO: 60601 - DNA, 493 bp, Homo sapiens
agttttaaaagctaatactactttaattgtactttttctcactcttctcttcctagcctctagttcctttttttccctgattatttacaacactgacttgctatgtgagctcagcaagtccctccttgcacaggatgaccccttccctaactcacaggggtagagagaggagcaatcgttatatggagctttaactctttggggaataagtgagactgatccagacaccacccctgaaggcctccatcaaacatggtaacagtccccacaggggtgagcatgctgaggccatcatgttaccacggggcagcagcatgtggaagatgtagtaaagacgtctctggagtgtctaccactgctatccgtcgcactcctctcctctgctccacttcgccttctaacactacccacaagctcagcgttccttcctctccctcctcagaataccctgggactgcctctcatttcaaatacaaatgctgcagcatgactc

SEQ ID NO: 60602 - DNA, 349 bp, Homo sapiens
aactatagaatgggtagtggtagaataaaatcatcaccttgaccttgtggccaattatagaaatgagggctatattacagctgcatatttttttatttgcctattatatgtacatattaatttgcatgttataaccattttgttcttcttcctcctacctattatccatttatatgcaagttcttggatgttaactttataatttagtctttaggtaacagaatattcagtggaactgtgactgaatttaaaaaataaataatatagccagcaaggatacaatgactgggactgcatatgtcctcattttggagaaagtgagaactttttcacttattcaaaggttagc

SEQ ID NO: 60603 - DNA, 401 bp, Homo sapiens
gagacggaggctcactctgtcacccaggctggagtgcaatggcatgatcttggctcactgcaaccccgcctcctgagttcaagtgattcttccacctcagcctcctgagtagctgggattacaggtacccgccatcatgcccggctaattttggtatttttgtggaaatggggtttcaccatgttggccaggctggtcttcaagtcctgacctcaggtgatcctcccacctcggcctcccaaagtgctgggattacaggcaggaggcacagtgcccggctggggatcctatttcttagttctcctaattccttaatatcattaaatattgccttgagttaatgtgtctttttttaaaattaaggttgtcaagtctacaatcagccacttaaatctcatttt

SEQ ID NO: 60604 - DNA, 513 bp, Homo sapiens
aatgtgaaaaaaattatattaaacctcaaatttgggggtttgatttggaagacattagcaagtaatttggaataagttcccatccccaactaacttggatcctgtagtccaagtaatagtcatggtctatcattcagttacttgtgctaggcactgtgttagatattaggtataaatattaacagaaggcagggagtgaagcccccaggcatagccagtcatgttgccctggaacacaaagaggtgtccaatctcctgcaggaagaggagctgctgccattctgggaacctcaagcttagttcagaggaaacatctatgaggagaagacccaaccaccttcaacttagaagaagcaaaagagttctgtggacccctctgtagagagggaggggcatgtgattcaagaggccacctggatatttcagttgaagtttatctttaaggctcgctgcttctctgctgtcatttataagttcattcaataaatactgagcactttctatgtatctgcc

SEQ ID NO: 60605 - DNA, 429 bp, Homo sapiens
ttctattttaagttcttgacaaacctccaaatggctttccacagtggctgaactaatttacattcccagcagcaatgtataagcattctcttttctcctcaaccttgtcagcaactattattttttgactttttaataatagccattctatctggtgtgagatggcatctacttgtggtttgaatttgcatttctctaatgagtagtgatgttgagcatttttcatgcgcttgttggctgtgttattatgtctttaaaaaagttcatttttgaaaaagtgaaatcccctctcactgccatcctcctgaagccctgctgccaagcatgatggagaagcagaaatgtttcctggttttcctggcaactttcccctggcaagcacacacacactctgtgaagcatgattctagaggaagataccttcctggt

SEQ ID NO: 60606 - DNA, 213 bp, Homo sapiens
ccaaatatagcatatagcacaaaattaaaaatacaaagaatatgaagcatagaggatagaatgaaaacatcccatgtattttacttgtagttgtagaaggaggagagagaaaattgaagtagagacaacagttgaagggttgatcactggaaaattttcagaacctgttgtaagacatcaaatcagaggttaaagtctaataacttccaaaag

SEQ ID NO: 60607 - DNA, 2487 bp, Homo sapiens
cctgccagcaacaagcaggagctgaaaaccagaagttgaggcgtgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacagggaaggtggaggtcatcaatgcccgggagacggtgccggccagccacgccccgagcctgctggaccagtgtgcacaggctctgccactgggcacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctgattc

SEQ ID NO: 60608 - DNA, 2483 bp, Homo sapiens
cctgccagcaacaagcaggagctgaaaaccagaagttgaggcgtgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccagagacggtgtcttgctttgttgccctggctgttctcaaactcctggcctcaagtgatcctgccaccttggctcccaagtggctaagactgtaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctgattc

SEQ ID NO: 60609 - DNA, 2320 bp, Homo sapiens
cctgccagcaacaagcaggagctgaaaaccagaagttgaggcgtgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatcttcttgtccattcatctgcccacccatccgtccctccgtctgcccaccagccgcccctctcctcctgggctgcagagccatggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacgagccatcctccagcagcagggctcacccgtggatgccaccatcgcggctctggtctgcaccagcgtcgtcaaccctcagagcatgggcctgggcggaggggtcatcttcaccatctacaatgtgacaacagggaaggtggaggtcatcaatgcccgggagacggtgccggccagccacgccccgagcctgctggaccagtgtgcacaggctctgccactgggcacaggggcccagtggatcggggtgcccggggagctccgtggctatgccgaggcccaccgccgccatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcgccagctcttcttcaacgggacagaacccctgaggcctcaggacccactcccatggcctgcactggccaccaccctggagaccgtggccacagagggcgtggaggtcttctacacggggaggctgggccagatgctggtggaggacattgccaaggaagggagccagctgacgctgcaggacctggccaagttccagcccgaggtggtggatgccctggaggtgcccctgggggactataccctgtactcaccaccgccgcctgcagggggtgccattctcagctttatcctcaacgtgctaagagggttcaacttctcaacagagtctatggccaggcctgaagggagggtgaacgtgtaccaccaccttgtagagacgctcaagtttgccaaggggcagaggtggaggctgggggaccctcgaagccacccgaagctccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctgattc

SEQ ID NO: 60610 - DNA, 1313 bp, Homo sapiens
cactccagacactacctacaccattcattagaccctgtactcaacaacgtcagttaacatggtctgtcactgtcacctatgtccatcctggtcctaacaagtgctatgttctctcaccaatacatatagagcgccgggcggaaggcgaggtgtactgtgtaccatccacgcattgtagtatcacgcctgctacattacgcgcaatcctagtcagaagagtgagatccatggcgagactctactatcgacacatttacgacccgctgccagtaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccctttggagcgatggtgtattcaccacggacaggcatcatcctcaacaacgagctcctggacttatgcgagcgatgcccccggggttccggcaccaccccctcacctgtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggccatcatgagcaagctgtggcttggctttgacctgagagcggccattgcagcccccatcctgcatgtcaacagcaagggctgtgtggagtacgagcccaacttcagccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctgattc

SEQ ID NO: 60611 - DNA, 839 bp, Homo sapiens
gtgaaccactgtgtctggcctcagtgtctaaatcttgagaagccacatcctccatcgaaggccccctgaactcagatttgcacctcaaggccctggtgtccttggatccagaacagacatgaacttgcatttggaggtcttcgggcctgggtggtgtccttcgtacatagtccctggaggctgagcttgtcctctatgggcctttggatctcttccatgctcccatctggtcctcccctcttcctgtgtcttcaggccctcttcctctccgtcttgccttttgatcatttttctcatttcttgcagaggcctctccctcctggagatgggctgagctgccctcccctgtgaacctgctttctctcctctccaggaggtgcagaggggactccaagaccgtggccagaaccagacccagaggcccttcttcctgaacgtggtccaggctgtgtcccaggagggggcctgtgtgtacgccgtctcggacctgaggaagagtggggaggccgcaggctactaagacactgctctgcccagagctgaagtctggccccaccatgagtcctgtgtccaggccggacatggctgggggaccaactactctggcaggatctggacccctggcaggggagtccagctgagagtggaagaggtggcggggaccagctgggcagatgagaggctgagcctcatccctaaccccctttcccagagcccctggtggtcctgaaccggcccctctatccctccgcaggcctcttgcctggggccactctcccaccctctcgatctgtatatcctccagtccaagattaaagaggcggactgtggcctgattc

SEQ ID NO: 60612 - DNA, 3225 bp, Homo sapiens
ctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaaaaa

SEQ ID NO: 60613 - DNA, 2392 bp, Homo sapiens
ggaccgggcatggtggtgggcacctgtaatcccagcactttgagaggccaaagcgggtggatcgctcgaggtcaggagcttgagaccagcctggccaacatggtgaaactccatctctactaaaaatacaaaaatgagctgggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaaaaa

SEQ ID NO: 60614 - DNA, 2023 bp, Homo sapiens
tgcgctcgctccgccgtccccctcttcgggggggcagaagcaggaagcagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaaaaa

SEQ ID NO: 60615 - DNA, 1828 bp, Homo sapiens
cgtgactctacaggacttccaaacaccgcatcttagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaaaaa

SEQ ID NO: 60616 - DNA, 1886 bp, Homo sapiens
tttttttgatgtcttaatcacaaagactttattccttcacaaaaacttgtttttgaatgtgaaaatagaattccatttcagtgaaggtgttgcttctagttttggttactgattttgataatattagagggatgattctttatctttttatttgtttcagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaaaaa

SEQ ID NO: 60617 - DNA, 2237 bp, Homo sapiens
  misc_feature (2217)..(2218): n is a, c, g, or t
  misc_feature (2225)..(2225): n is a, c, g, or t
ctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgcgtgtttgnngatcctntagatcaccagc

SEQ ID NO: 60618 - DNA, 1529 bp, Homo sapiens
ctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggccatctcatctccataagcctgagttgtggagagaggcaaagtttttatcaaggagaaaattctgatctgctcaaatcctaggccgggctcggtggctcatgcctgtaatcccagtactttgcgaggccgaggcaggcggatcacctgaggtcaggagttcgagaccagcctgaccaacatggagaaacccagtctctactaaaaatacaacattagccaggtgtggtggtacatgcctgtaatcccagctactcgggaggctgagacaggagaattgcttgaacccaggaggcggaggttgcagtgagccaagattgcgccattgcactccagcctgggcaacaagagtgaaactctgtctcca

SEQ ID NO: 60619 - DNA, 369 bp, Homo sapiens
cggttccactatgttgcctcagctggtttcgaactcctgtgctgaaacaatcctcccaacttggcctcccaaagtgctgtgattataggcatgagccactgcgcctggccaagaatgcttattttttaatgtgactgaatactttttctttgtgactttgtttttaatacccatctagaatgaaatgttttcagagagagaatagttgtctacagatatgctacacatggattaaatttcccctctttcattgattgttgttttaggtggtgcttcctacatttatcctagagaagcgttccttgctggaaatgtatgcagactttatgtctcatccagacctatttatagccatcactaatggagcca

SEQ ID NO: 60620 - DNA, 253 bp, Homo sapiens
caaagtgctgggattacaggcatgagccaccgcgcctggcccacttggtgtattttaaaatgtgtttatgctttcttttttggtagccatgacatctccctggcaactgtacaacctgtctaatctataaattatagtgaagagtagaaaacagcttagggctgggcacagtggctcacacctgtaagcccagcactttgtgaggccaagacaggcagattgcttgagcttaggagttcaagaccagcctggg

SEQ ID NO: 60621 - DNA, 227 bp, Homo sapiens
atctccatcatgtaattagcttcaccttcagtactgctcagagagacagagtctttatcacatctaggcatttcctcatcttgcagagggaaaaaattcctaccattgcaatatttttaaattattcatatctttaatctttctatcttgcatttgtttatggaaaatttttaaaaagttgattcagtttggggttaaaagtaaggttatttcaagtacatataaga

SEQ ID NO: 60622 - DNA, 384 bp, Homo sapiens
ctgagagccaggagctcttgcggagaagccactgtctgcacgccacctgcttcgatgaccctgctctgccatccctgtgctccaagggccgggccctgccgttgcctgtgccagacgggtctcagggagatgccggccagcaggtatgcatggcgaggcctgggcatcaaggcccggattctatggctgccagtttcattctctcgttgtttgtccccctagcaagacttatgaggttccttgaggacaagactccctcctgccacctggtctgtttcctgaacattcactgcactagcacggccccgggacgcagcccttgggaatcaggccgtcggccatggtagagcggctggcactgctcggcaccgtgacggacgttgg

SEQ ID NO: 60623 - DNA, 775 bp, Homo sapiens
ggactcaaagacattgaacaacggacccaaggtcatgcagaaaagtcagtactgagcctggaggatccttgagctcttcatcttaaccttctccttgaagtgccaaaattgctggccagcccctcagagcaggagcagccatccttgtcctgacagtccacccagggcagcagtgagcctccctgtgtgggatgggaccaaggcttctgtctgattcccaaccctatccagccccctctctccagcccttcccacctgtttgcctctacccgcgtcagagttctgacagtctaactctctcccacactactgctctggaccttgacgcagcaaagcagtcacagtcgtcaacccactggaggacacatagcctggagcccaggtgaggcttgcagactcagtagcttggagctatcagatggccatcctgcattactgcaagccctgcccagaggctgagtgaaggccatcaggctgaccgagccacagctctgaaagaatgccgcagctcagtggctcccagctttgccgcacctcacaatcacctggggagctttgaaaattcccactgcctgggctgcacaccctaccagtgaaatcagaatatctcagggtgggagtcaggcagcagtcgttttggttttgttttttcttttaaagaacccaggtgatgtaatcccagcactttgggaggctgaggcaggcggatcacaaggtcagcagttcgagaccagcctggccaatatggcgaaaccccgtctctactaaaaaataa

SEQ ID NO: 60624 - DNA, 284 bp, Homo sapiens
cttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaacct

SEQ ID NO: 60625 - DNA, 98 bp, Homo sapiens
tctcttcttgccaccatgtagtatcatctcattctatagaacaaagaaagcagcaaccccaaatagtgtgatatatgctaactcttccctctttcaaa

SEQ ID NO: 60626 - DNA, 4239 bp, Homo sapiens
cccgcctaatcttcacccgctgctaggctcgtttaatgagtcttctgagagctaaggagtcctcggattcattcaaagcattctacaatgaacgctaggggggaaaaagaacaaacaaaatacatttcaaatataggattcaattacttttcactactcaatgatgtgtcaaaggcacgctgtgttttgttttgagggcggggagatgacaggagggaatcctgggcccccattggctcgccgctcgccgctgcagttgagctccagccgctccgagagcattattgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgcgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaatatagacaagctggaacccaggagcagttgggagttttaaagaatgccagcctttttaaagctttgatgtccagtgctatagaatcaagttactgtggaggtcaaaacaatttgagatacataagctggccttagaaaataaattgcctctaacttacagtgaggagctcaacataacagggaaaaggagcacaggatgcagctacttggagggtgttgattgaaaacttcgatctccccaccccattcacggttgatttgacggatttctcaccttgttcacagagaaaatttcaattaaggcccctttagatggaatataatacagcagaagccttttcatcaaaaggattaatgcctgcatcatcatttctgcaataaaacaagaagctaagcggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacactctttctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtcccaaattctagaaacaatgtttgatcttaacattagttcacattaaagctgttcattaaaatgttactttcttttcc

SEQ ID NO: 60627 - DNA, 923 bp, Homo sapiens
  misc_feature (923)..(923): n is a, c, g, or t
cccccactcgccacccaccccaccccaccatgcaagccggtttcggccgtcagcccaaccgcccttgtctggataagacttggagcgacgaatcctaaattctttcggccatgggacaccccgtggaatcaagcatttggccaagggcctccccgccgtttaagtgcacctacgttctccccttaaccagcccatttaatgtcaccgcttcagcaagagtccgggggcgaacaacccaggctccagtaatccatcctaatggggccagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttaggttggtttcaatattaatcattgttaattttttctcgctctctcttcctttttttcccctctctctcctccatctctctcctcaatttatcatgtaaacaagtttttattcattgacatgtcatacctagctagaagataatctatgtgtattgaattaaattgttattaatgctatttttctatttcatacttcttggatatatattattggggataaataaataacatcataaaataaacacctggcctcgttggcctcagcggtggagctctgccgccggan

SEQ ID NO: 60628 - DNA, 2153 bp, Homo sapiens
cccgcctaatcttcacccgctgctaggctcgtttaatgagtcttctgagagctaaggagtcctcggattcattcaaagcattctacaatgaacgctaggggggaaaaagaacaaacaaaatacatttcaaatataggattcaattacttttcactactcaatgatgtgtcaaaggcacgctgtgttttgttttgagggcggggagatgacaggagggaatcctgggcccccattggctcgccgctcgccgctgcagttgagctccagccgctccgagagcattattgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgcgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaatatagacaagctggaacccaggagcagttgggagttttaaagaatgccagcctttttaaagctttgatgtccagtgctatagaatcaagttactgtggaggtcaaaacaatttgagatacataagctggccttagaaaataaattgcctctaacttacagtgaggagctcaacataacagggaaaaggagcacaggatgcagctacttggagggtgttgattgaaaacttcgatctccccaccccattcacggttgatttgacggatttctcaccttgttcacagagaaaatttcaattaaggcccctttagatggaatataatacagcagaagccttttcatcaaaaggattaatgcctgcatcatcatttctgcaataaaacaagaagctaagcggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaaggtatatagacaaatgttgggacagttgactactaaataataattaaagaagataaaaaataaa

SEQ ID NO: 60629 - DNA, 4181 bp, Homo sapiens
cccgcctaatcttcacccgctgctaggctcgtttaatgagtcttctgagagctaaggagtcctcggattcattcaaagcattctacaatgaacgctaggggggaaaaagaacaaacaaaatacatttcaaatataggattcaattacttttcactactcaatgatgtgtcaaaggcacgctgtgttttgttttgagggcggggagatgacaggagggaatcctgggcccccattggctcgccgctcgccgctgcagttgagctccagccgctccgagagcattattgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgcgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaatatagacaagctggaacccaggagcagttgggagttttaaagaatgccagcctttttaaagctttgatgtccagtgctatagaatcaagttactgtggaggtcaaaacaatttgagatacataagctggccttagaaaataaattgcctctaacttacagtgaggagctcaacataacagggaaaaggagcacaggatgcagctacttggagggtgttgattgaaaacttcgatctccccaccccattcacggttgatttgacggatttctcaccttgttcacagagaaaatttcaattaaggcccctttagatggaatataatacagcagaagccttttcatcaaaaggattaatgcctgcatcatcatttctgcaataaaacaagaagctaagcggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaacacacacacacacactctttctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtcccaaattctagaaacaatgtttgatcttaacattagttcacattaaagctgttcattaaaatgttactttcttttcc

SEQ ID NO: 60630 - DNA, 3398 bp, Homo sapiens
cccgcctaatcttcacccgctgctaggctcgtttaatgagtcttctgagagctaaggagtcctcggattcattcaaagcattctacaatgaacgctaggggggaaaaagaacaaacaaaatacatttcaaatataggattcaattacttttcactactcaatgatgtgtcaaaggcacgctgtgttttgttttgagggcggggagatgacaggagggaatcctgggcccccattggctcgccgctcgccgctgcagttgagctccagccgctccgagagcattattgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgcgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaatatagacaagctggaacccaggagcagttgggagttttaaagaatgccagcctttttaaagctttgatgtccagtgctatagaatcaagttactgtggaggtcaaaacaatttgagatacataagctggccttagaaaataaattgcctctaacttacagtgaggagctcaacataacagggaaaaggagcacaggatgcagctacttggagggtgttgattgaaaacttcgatctccccaccccattcacggttgatttgacggatttctcaccttgttcacagagaaaatttcaattaaggcccctttagatggaatataatacagcagaagccttttcatcaaaaggattaatgcctgcatcatcatttctgcaataaaacaagaagctaagcggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagctgagtcctggagtattcctatattttgaaagttgtaagagtcaaaatggagtcactaatgtcaagaaaaccctgacaaatagagctagggaagaccatggagagagggttttcacccttatatgcctgtaatgaaaaagactgtaaaaatcacaaccccgcacaaaggccatcacaaccttatacaaaatcatttctgccggaacatctgcccagcaactgcctgtccaatgttggactggcatcacccttgttattaatctttgtagtcaaggataattatttaaaacaattatgtatcctcctcgtttttttctttgaaaacctttgtcttcctttatctcttgaacacacacatagtttactatggcactcacattcccattgctatactctatttccaaataaatatattttatttcaga

SEQ ID NO: 60631 - DNA, 1613 bp, Homo sapiens
tgttattcataacgcacaaaaaaagaacctcgaggataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaacacacacacacacactctttctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtcccaaattctagaaacaatgtttgatcttaacattagttcacattaaagctgttcattaaaatgttactttcttttcc

SEQ ID NO: 60632 - DNA, 542 bp, Homo sapiens
ctgaaacatatattctcacgttgggtacctgctgtttttaatgactaattttttccccctgatacagccatcatttagcaaataccagggctagttattaatttaaaaacaccttcagcctgtgcttacagaaactgccatttcccccctcgggaatgagtttttcgttatgtttttaaaattagctggcgcttgaatttcattttccatccaagcttccctgttatctgtaaggtcacagaaacacataggccgcggacagtccaatcccagatattaggctcccggaattaaaagctgaaataagtaaataaagagagaacgcccagggattttttcagagcagaaagccggtccccagcgtgacgcggaagccaggttgcctcctcaagtgactcttcccttacatttggaggtgaaggctgaggaagaagaggtgacagagaaggaaaaaggcctgtgccctatatcgccaagatctgtttcttctccgctcagcaacgtgaaagaatgagaatgcattctggaggaagaagggaaaa

SEQ ID NO: 60633 - DNA, 315 bp, Homo sapiens
ccattcagaattcctggagcacatgaggtagcccccagttagatagaatgtggtattgtttgctgctattttgcctgttttgtgctgtatcacctcatccatctccccagcttaattgcaagctatttgacgggcagaaattgtgtcttatttgtatttgttttccccattgggcccggcacactgattggcatattgcagatgtttagtacttgagagaaacaaaatgtcttctagcatttgtggatgaaagattaaaatgtccaggaaaatttacttagattgatgtggattgaaactatattagattaataa

SEQ ID NO: 60634 - DNA, 211 bp, Homo sapiens
agcttctccagcagaaaactggcacctggacttgccctccaaagagatccaggagaaaagatgctgggtaccaaacatggcaaatttctacttcaaaagtaacacatgagaaactatcaatagcagcaagatttcattttgtgttagagatactctatgcagaagaacctgaaggcttggtctcctcccactgaggctgtgtaggggccag

SEQ ID NO: 60635 - DNA, 343 bp, Homo sapiens
aattgagctcagactaaaggaattcttttttgactaaatagtgattaagttatgatattcctgttggcctaagaacaatgcctatgatttagttgtgttatgtatatttgtacttataaccaaacaatcgattgggtacaagtagccttagggcaatacttccttaaaaacatgtttctgataaactaaagctttagcattaaccagaagtcataatttaatagtattgtaaaaatacctcatttattttaaatcctgtgttgggtagaggattacagttgtcatttcaaatacatgaatctcttgtcaaaagagtactttgacagtttcatggtaagacccc

SEQ ID NO: 60636 - DNA, 401 bp, Homo sapiens
aagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctccttttggccttccaaactgcatttgtttaggtgaattaagaaaaatattgccatcaagaattacttgtgttttcacagagatagactctttgctttatagaggttgttgggtatttaatatgaatatcccagctttagaaaagagtaaactggatacaaaaagttccattgaggaacagttatttacagtaaaa

SEQ ID NO: 60637 - DNA, 401 bp, Homo sapiens
gagctgctaaaaatgcagacctggagtttgaggaagctgggggataaaagtcctattggagccatctacttagaattgccagttgaaatgacagccagataagtctgtgagcaaagaaagaagagaaaaaagaaatggctgggcatggtggttcacacctgtaatcccaacactttgagaggccaaggagcgataactgcacaagcccaggcatttgagaccagcatgcctatgccacatagggagaccctgtctttacaacaacaacaaattagccaggcatggtgatgcatgcctgtagtcccagcttcttgggaggctgagatgggaggatcacttgagcctggcgtttcaagcccggatagcaccattgctctccagtctgggcgaaggagtgaggc

SEQ ID NO: 60638 - DNA, 627 bp, Homo sapiens
agagtctactgtgatctttgtcagcaaatcgctgtgttatcttagatgttcagtactgaatcagtgatttcaggaatatcacacttctgggtgcctctactggccatctgtaagatggggacacatcctctttctctgggcagttaattcttgggctctttactagaaagtctttcaaaactgtgtttgctgggtgggtgaggtggctcacgcctgtaatcccagcaacttgggaggcccaggtgggaagatcacctgaggccaggacttcacgtccagcctgggcaacagtgagatcctgtctctaccagaaaaataagagataataataactggtgtggtagtgcatgcctgtagtcctggctactcaggaggctgaggcaggaggatggcttgagcctgggagctcacggttacagtaagctataattgtgccactgtactccagtctgggtgacagtgtgaggccctgtcttaaaaaaaaataaataaataaaccccaaaccccaaatggtgtttgctctcaatatggagggtgccctgctgcatggcctccgagctctgggttcttctcaattcctgagtctgtaactctgttgatatgactaggtagctcctgcaatgtgc

SEQ ID NO: 60639 - DNA, 301 bp, Homo sapiens
ctttaaaaggttccccgccccctttggtcctggttggcaatttcaatgggtcctggccccccctcccttcaaattttaaagggggccccaggaccccccctttttttttttttttttttttttctgggtgacagtgtgaggccctgtcttaaaaaaaaataaataaataaaccccaaaccccaaatggtgtttgctctcaatatggagggtgccctgctgcatggcctccgagctctgggttcttctcaattcctgagtctgtaactctgttgatatgactaggtagctcctgcaatgtgc

SEQ ID NO: 60640 - DNA, 826 bp, Homo sapiens
aaactccccaccaaactcctccccacccagagaacccccggtcctccccttcctcctgaaggcctgaggctccctgtgaccctccgccccacctctcgcaggtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60641 - DNA, 3087 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60642 - DNA, 3134 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60643 - DNA, 2967 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60644 - DNA, 799 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtcccgcacggccatcctgaggcggggtccggcacaccacagcgtggtgggcgcgagtgactgtttcatggtccggatccgcccattcgtggtgagcttgctcaggagagtgagcgggccctt

SEQ ID NO: 60645 - DNA, 736 bp, Homo sapiens
  misc_feature (4)..(4): n is a, c, g, or t
  misc_feature (6)..(6): n is a, c, g, or t
  misc_feature (599)..(599): n is a, c, g, or t
  misc_feature (619)..(619): n is a, c, g, or t
  misc_feature (649)..(649): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgagcagcattcgggccgagatgtctcgctccgtggncttagctgtgctcgcgctantctctctttctggcctggaggctatccagngtactccaaagattcaggtttactcacgtcatccagcagagaatggaaagtcaatttcctgagcttgctatgtggtctgggtttcaa

SEQ ID NO: 60646 - DNA, 3246 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaaggtcagtaggtctccaaggacttgtgtccccgctgctgctcatctgatcactgagaagaggaggcctgtgtgggaacacacggtcattctaggggccttcccctgccctccagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60647 - DNA, 3540 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttggtatggcttctgaggtgggagagggtggcaggggtgggaagagtgggcaccaggagggggctgctgggctgagcaaagctggaaaggatccttgcccaggccctgagaaggtggcggcagggcagggctcaaccactgagactcagtcagtgcctggcttccagcaagcattcatctatcactgtgtctgcgagagaggactggccttgcagggcgcagggccctaagctgggctgcagagctggtgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtggtggtaagagactctagcagggagtgaagggatgcctggggagacagacctgcccctcttggaccttagatgcttccctctgtccctgatgtagactccttgacctccagcaacgatgatgaggaccccaagtcccatagggacctctcgaataggcacagttacccccagcaaggtcagtaggtctccaaggacttgtgtccccgctgctgctcatctgatcactgagaagaggaggcctgtgtgggaacacacggtcattctaggggccttcccctgccctccagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60648 - DNA, 2964 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttggtggtaagagactctagcagggagtgaagggatgcctggggagacagacctgcccctcttggaccttagatgcttccctctgtccctgatgtagactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60649 - DNA, 3092 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60650 - DNA, 2922 bp, Homo sapiens
  misc_feature (4)..(4): n is a, c, g, or t
  misc_feature (6)..(6): n is a, c, g, or t
  misc_feature (2832)..(2832): n is a, c, g, or t
  misc_feature (2836)..(2836): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccatacncggngttggcttaccctttccccccgggttgggccttttggaggggcccccaaagcgaaagaggggtttttgaaaagcgggtcccggggc

SEQ ID NO: 60651 - DNA, 1836 bp, Homo sapiens
taggctaggtacgaggctggtgtgaatcggccgacgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60652 - DNA, 1603 bp, Homo sapiens
taggctaggtacgaggctggtgtgaatcggccgagtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtct

SEQ ID NO: 60653 - DNA, 2685 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccgaaaacaggagcaaatggcgttttataaattatttttttgaaataaagctctgtgtgcctgggtct

SEQ ID NO: 60654 - DNA, 2963 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggaggcctcaggctgggacaggactgcccaaccaggacagccttcatggaggccatcgggattgcccccgtctgcccccagggagtggtggctgaaaatgcatatgcggtcagaggggtcagacagagggattggaggctggggcctccttggaagactgagcgtcagctcatgattgtttatcctcactctgggctcctcccagctctcagcatagcctctccagctgacggtatcccacacagaactcatcttacccccagaactgtacctcctccagggcaggaaccagggagtcacctgactacttccctcaagaaccctgttccaggccaggtgcggcagctcacccctgtaatcccagcactttgggagaccgaggcgggcggatcacctgaggtcaagaattcaagaccattctggacaacatggcaaaaccctgtctctactaa

SEQ ID NO: 60655 - DNA, 2155 bp, Homo sapiens
  misc_feature (4)..(4): n is a, c, g, or t
  misc_feature (6)..(6): n is a, c, g, or t
  misc_feature (1909)..(1909): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcggctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtgggnttgtacgcccggccagaccgagccagctcagctgtactagccaggctgtgcgaagccaagttacctcacctctgtaagcctccatttcctcttgtgtaagttgggggttatggcagctacctcggaattgcatgaggctgtgtgtaaagcacgtagctcagtgcctggcactgagtccaggctcagccagcctttgcagttggtattggaatgaatacatatttcatagtgatcgtggggttgtaa

SEQ ID NO: 60656 - DNA, 1032 bp, Homo sapiens
  misc_feature (4)..(4): n is a, c, g, or t
  misc_feature (6)..(6): n is a, c, g, or t
  misc_feature (957)..(957): n is a, c, g, or t
  misc_feature (967)..(967): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccagcaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttggtggtaagagactctagcagggagtgaagggatgcctggggagacagacctgcccctcttggaccttagatgcttccctctgtccctgatgtagactccttgacctccagcaacgatgatgaggaccccaagtcccatagggacctctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgttataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtctcacggngagtcgacgnggttcccatggcaggccaaaagggactcctgtccagggggccgccgggagggcggggaggggccc

SEQ ID NO: 60657 - DNA, 580 bp, Homo sapiens
  misc_feature (4)..(4): n is a, c, g, or t
  misc_feature (6)..(6): n is a, c, g, or t
ggangnggcgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttggtatggcttctgaggtgggagagggtggcaggggtgggaagagtgggcaccaggagggggctgctgggctgagcaaagctggaaaggatccttgcccaggccctgagaaggtggcggcagggcagggctcaaccactgagactcagtcagtgcctggcttccacgtcttgacgggagcattggcccctgagcccagagaagctggaagcctgccgaaaacaggagcaaatggcgttttataaattatttttttgaaataaagctctgtgtgcctgggtct

SEQ ID NO: 60658 - DNA, 268 bp, Homo sapiens
cgccctcccagaggcctaccttcaagcagctggtggaggcgctggacaaggtcctgctggccgtctctgaggaggtacagcccctcccacccaccacctccctctgcctgctcccctccaggcctcatctggcctgaccgcgtggacatgcgccccgtcccatcccgggcgctgcagaggctgaccagctccgttccccacagtacctcgacctccgcctgaccttcggaccctattccccctctggtggggacgccagcagcacctg

SEQ ID NO: 60659 - DNA, 291 bp, Homo sapiens
acaccatagcatatggatttatagattagaaaatttctcccataaaactgagaagtaatgaatctgaggttaggagtttgattagaggtagacagaagtactacgaccattgtggtgaggagaacaagggaatttcttaggatctctggccttatttgttacctgaggtaggtggtttgaaaatctgtagcccttaatgggaagaggagtgaaagaaaataatcagaggaagatctactttgttatttttatgttggagaagagttcaagaacctaagtgtccattatgtt

SEQ ID NO: 60660 - DNA, 223 bp, Homo sapiens
gtatatatacttaaaaatgtctaatcatgcaaggcaaaatagaatcttcattctcttttaagtattttgtttaacactcaagatttagcagaatatgatgtgaatctgcgcttgagttaacctcctttgtaactagggataaaagtatttttcttcttgagaggtgctataggattcagcagatcacaaattaataaaattggcaattaagttacatggtacg

SEQ ID NO: 60661 - DNA, 349 bp, Homo sapiens
gacactttcagaattaagaagccttgccctctttgcgtgtcttcacaattgtgttaagtctattatagtattcattttagtttgaaagcaataaatacaatattagtacaagcacactgtcaagaaatccctagaatatggctcctctgaaggttgacatgggtctgcctcgcatgtatcttttcatctccagcatccagatcagagtcaacaacaacaactctacaaatatcaggcttcttggtggaaagaaatctggacattttttctatgaaaaaaaagttaggttacatggcattaatatttttgctagacttaacctacagaaaatgtttcaagcttataaaaa

SEQ ID NO: 60662 - DNA, 277 bp, Homo sapiens
gccaataccatgctgtcttaatttgtttatagatttgtaagtatgctaatttctgataaggtatctttgatatgttttctttaggtgctgttttgtcatgggtctgtctattcttatgcaaataattaaagtatttttactttaattatttagtgacagatttaaccatattatatttttctttattaaaatttttcatggaaattaggatgaagtaatggattatgggtacactgtaatttacctaattatatctagtgtggtatatttagttgct

SEQ ID NO: 60663 - DNA, 370 bp, Homo sapiens
ttaactctttcttctcttcagtcggattatagagttggagcaaatgtcatgatgaactttgaggcctaggcctggactcttgaggtgtgtgtgtgtgtgtgtgtgtgtgtgtgtgtgtttctttctccataatagtcccaaccctaaacaggggtatggcacagtacttcttatgaacaaaagtgctattggtctacaaggggacttgagcctgcactaattgtatttgattaggatttttgtgctgtctgtatgatgtttaaccacactgtcaattacagacttcctttaaggaatttccaggaaacccccttaccataagagtttaaattaatagtttgctagtttaatgacagcagttggtaaagga

SEQ ID NO: 60664 - DNA, 3722 bp, Homo sapiens
  misc_feature (1966)..(1966): n is a, c, g, or t
  misc_feature (1986)..(1986): n is a, c, g, or t
  misc_feature (2156)..(2156): n is a, c, g, or t
  misc_feature (2695)..(2695): n is a, c, g, or t
aacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcggcctcatccccaccactgcatacatggctgacagttttgaaaaaagagcaggagttcctgggggtaacacaaattctgactgctatgatatgcctttgttttggaacagttgtctgctctgtacttgatatttcacacattgagggagacattttttcatcatttaaagcaggttatccattctggggagccatatttttttctatttctggaatgttgtcaattatatctgaaaggagaaatgcaacatatctggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgaaattgtagtgatgatgctgtttctcaccattctgggacttggtagtgctgtgtcactcacaatctgtggagctggggaagaactcaaaggaaacaaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttacattagatttattcgcctgataagaatattttgtttctgctgcttctgtccaccttaatattctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaattttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgagtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggntgaggcaggagaatcgcttnaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagctcatttttnggctttgattttggggagacaaagggaaatgcagccatagagggcctgatgacatccaatacagagttctggtaaagataaaatttgatacaggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagaaattccacacatgagtattgtgatgagtaaatgaataaaacatttgcaaagacctttagagaaagagaatgggagcatatgtgngaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtacgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttgatttcttatctgtgtttgtgttggcatgcaagatttaggtacttatcaagataatggggaattaaggcatcaataaa

SEQ ID NO: 60665 - DNA, 785 bp, Homo sapiens
ctcccttcaatgaccttcctgtcccataggagttctcaggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacaggtggaagtccttcagggtccagcagcaacctgtatcagaagaacatccttctctgcttgacctgaagaagggccagacctgggcagaaagactccagcaggtgagctcttcatgcgacagtgtcagcactggagtcttcttgctgaactgcgaataaagagatgtgctgtttaacaaacc

SEQ ID NO: 60666 - DNA, 899 bp, Homo sapiens
ctcccttcaatgaccttcctgtcccataggagttctcaggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacagatggagctttgggaacgcggagaacagtggggttacagggagtcatcatcagccctaccccttggccaaccacatctccctgctgtgtcccctgggcatttctctacctcccaggtggaagtccttcagggtccagcagcaacctgtatcagaagaacatccttctctgcttgacctgaagaagggccagacctgggcagaaagactccagcaggtgagctcttcatgcgacagtgtcagcactggagtcttcttgctgaactgcgaataaagagatgtgctgtttaacaaacc

SEQ ID NO: 60667 - DNA, 1219 bp, Homo sapiens
  misc_feature (2)..(2): n is a, c, g, or t
gngcacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaactaaaaa

SEQ ID NO: 60668 - DNA, 442 bp, Homo sapiens
tccgtctcataaacaaacaaataaacaaataaataaataaagtttggatcctttttctaaaacaacacacatatgaaacttagataatagttttcagaggtttcctgaacccctgaagcccatctgtagacctcagttaagaattccctttctaggccgggcatggtggctcacgcctgtaatcccagcactttgggaggccaaggcactaggatcactcaagatcaggagttcaagcctggccaacatgatgaaaccctgtctctactaaaaatacaaaattagccagcgtggtggcacgcacctgtaatcccagctactcaggaggctgaggcaggagaatcacttgaacccgggaggcagaggttgcagtgagccgagatcgcaccactgcactccagcctgggcaaaaagagtgaaactccatctcaaaaaaaaaaaa

SEQ ID NO: 60669 - DNA, 805 bp, Homo sapiens
gaaggtaaatgattcttgttgtttttttatttaataaatcaaagaagccattttatttaaatgcttgttttaaatacaatacttagcaaacaattggtgaagcagttttagacagtttatcaagacaccataggaaataggcatcagtagttcctgtaggtaaaggtagataaattgttcttttgatacctgagaagtcttactttcagtgaagcgcttggttgaatgatctgccaggaaaaacttagatggtagatgttggtcttttccattgtggaaactggtggtcattgttttttgaaaacaagtattaaacgtgaattactatctttgttcagtgggcttatgtttcagactgctggagatgctgcaggttacagtagaagcttttactgtactctatagcagaagtagtgatgtattagcagaggtacagatgacatgcagtgtgaagtgggctgccataatagggagaaagctaggaaaaatgaactgaagtagcatttagaggaaattctggctctacaatgggatggatcaatacctgttaccttgaagcaaaaagtgatttttgtactttctagacatttttctaataataacctgccaagtgccaggcgttgtgatatgtagttttgtgtattgtctaaggctcacagcaatcgtttgatgttgggcaggatggcttgtgcttgtagtcccagctactcgggaggctgaggcaggaggattgcttgagcccaggagttcgaggccagcctggggcaacatagaccctgtcttttcttttcttttcttttctttt

SEQ ID NO: 60670 - DNA, 306 bp, Homo sapiens
ttctccctcactgaaccttcccagcagcagctgctgacatatgaacctcgcagatgaagatgccatagcatggctatttctcgactgcactgctgaaggtaagatagtgagaaaatgctttttcgtagcaatttctttgtcatttttaacagggtcaaactcaaatactcataaaaggagattgagagccaatatgctataccatcaaatttaaaaagcaaaaaaatcaaagccataaactgttatcatttccagtatgttattccttctaatgctagcccattagtttcaataaaagaacaacag

SEQ ID NO: 60671 - DNA, 212 bp, Homo sapiens
taacattctctccaacctccccaggtcccatcagtgttgagaaggaatctaggccagctcctgggagatgccagttagccgctttgatcctgtgctttccaattgcccttatagcagtcgatgtcaggattggacaacttcaaaacaagtccataaagtccccatggcactaggggctctgggacccagtgtcgagaggcttagagcattgc

SEQ ID NO: 60672 - DNA, 386 bp, Homo sapiens
aacaagttactttatttctttgcccttaattttctcatcgattaaaggaaattaatacctatagggtaggatggtggtaaaaattagacaacatgtgatcaaattgccaagtgcctagtaaatgctaaataagtagtattataattagttttagttttgatttttgtttgttgtaaataaacagacttctacttctggtgatttaccagccaatagtgcttaaatgaagttgccctctgttaatggagtatttaactcctaagaaaaagtttccatcagtctctcttgttctagtttgtttttgttttttttccttttttttgaggcagagtctcgcactgtcgccaggctggagtgcagtggcgagatctctgctcactgcaacc

SEQ ID NO: 60673 - DNA, 302 bp, Homo sapiens
ggagaaagaaaggtaaagagaggaagataaaagggagaaaaggagggagcaaatagatggttatcagtgagagctaaatcatcaatttccatagcagaaagtcaatacttaatgactacataagtctgttattcagaaatatggatataaatactagaaggaacagataaaagaggaaacatctaaaacagtcaaaactgcttgtaggaagagggacgtcagcaagatggcagaataggactttcaaggactcgtccctgcccctcccatctcccccatcagaaacatcaatttgaataact

SEQ ID NO: 60674 - DNA, 315 bp, Homo sapiens
ctcctttccatcatttagttctctaaaagtattagctttgttattggttttgctattttagtttttctgatgtctttaaggaggaattcagggaaataaaaaaactttcaccaccagtttttttctttccagaaaaccgtggagtttgtatttctttttacctgggttccttttacattatgcttttatttatcccgggagatttctggcattccagttaattatacttagagacattgtagtatttttagatgtcagttgatctttgttcatttgataaagtacattttcaaaatggaaactttctgctatatt

SEQ ID NO: 60675 - DNA, 372 bp, Homo sapiens
ctcaaactcttgggctcaagctttcctcccacctcggctttccaaagtgctgggataacaggcatgagccaccgtgcctggcctagtccttatctttaaataatttacagtatacttacaggtttggaatatgtttcagccattcctttacctgtatgctgatacttcaacagcatgtcttagaagtaacttaaataatagtaacttaggggagccttatttgctctgtcagacagtatttttgagtacccaagtcctagttttttctctgtttgcttctgagacctgttttctgcccgatctgtatcccaggaggccaacccctatgcaccagggctcctatgccagctggcttcttggcagcttcagcca

SEQ ID NO: 60676 - DNA, 219 bp, Homo sapiens
aatcatacacataatacacaaaccaaagacaaatgatgaatattatgtcagaaaatataaagtcttcccctttcttcttttgccaagaaagtccaatattttcaccatttttatgcacacaatcaactttatttaagctggaagttaatgtctcattgttttcattgttctaaataaacaccttttcccttgagtattgttctaaaaaaaattgaagtt

SEQ ID NO: 60677 - DNA, 798 bp, Homo sapiens
ccaggtgaaagctagcgttccatgttctgcctactactctctaagtttattcattttgtttgggtttgggcttctcggtattccctaccaattttctagctcatcaatacattttaaaagatttttaagttattttatccagcattaaagttgctgagccacactcccagaagcagaagtgcatctgtgagttccttaaaggaaaccaatagatacctgacttggaacacccggctctgcttcagcttccttcagtctccaaatgggtgtgagctgaagttctcacacccagttaattccatagcctcttactattgtgaactgcgcacctttcccctgggggctaaaagcccaattattttccagtacatgcactttctacacaaacagcagaaattcaggttgctctccttacaaacagcgttgttctctttcccttttctctgggaggtaccagtgcaggttttaaaacctctgctctcctgggtaggctcaatgtttgagtgctctttctcacattcatcttgcaagtaggagcggtggtgaacgctgccttccgcactaggtggaaggcttactcgtctaaggaattctttttctttcttttgagagagggtcttgctctgtcacgccagctggagtacagtggcacgatctcagctcactgcatcctcaacctcccctagctcaagctgaggcaggagaatcgcttgaacccaggaggcggaggttgtagtgagccaagaattggccattgcactccagactgggcaacaacagcaaaactccgcctcaaac

SEQ ID NO: 60678 - DNA, 510 bp, Homo sapiens
gtcgtgagtgaatgtagggaggaaagggctatccagggtttttttggcctgttttccttcctgaacgtgtgaaagaatggaaattggtaagtcacagcagggagcacgtttcaggggcatcaggaattgggttttggacttggtgaatctaaggtgttctgcactggaggttcatcacgggtagctgaacatgcaggtctggggttctagagagggagttgtgctagagacttcaatgggtgaggcataaggtcaaagcctgtagtagatcagatttagagggtggaatttcaaggaagttattttgtgtggtctctgaagtgagaggtgggtttagggtggaaggccagggatgaaggggtggacacttaagattccttccagaaaggaggggtcctggcatgtgaaagcattctagatggtgttgttggaagtcaatgcttggtgctgcaaagtgaaaccagcactcaggcaaaagttttctcagcaaggcaatttacttctgtgcaa

SEQ ID NO: 60679 - DNA, 570 bp, Homo sapiens
gcgtcctctcccgggaatgtacccacaggccccctctacgcgcttgggttgcccaggaaaccccaacggtgaccccacaatgcccagcagagccctcgccctctgccaatgacggggtcaccagaatccagcgacccaaggaatccctcaaataagtcggccaaatttcgctgcgaactgatttacacatatggcctcacctggacaagaaggaatcttggaagttcctggggcccaactcctggttcacgaagacacacagcgtccacgagcagggggctgcgcagcctcccctgggtcgaggcgtgggtttcagcctcaggcgtgtgttgcgctggagatttgtattttgtgaactggtttcaggtggtctcagcacttttctgttaacagggaaccagagtttcaggaaagatctcaaaacctaattttcttcatctcgcctcactcaaaggcctctttcttgtaagactatgattgttttttttaaataattttttttctgattgcaaacataagatttttgaagaaatgttgtaaaactaatacaaaaaagaaatactccttttt

SEQ ID NO: 60680 - DNA, 433 bp, Homo sapiens
caagggtaaaaatttaacaaaattaataatttgcactgcttcatcaaggacattctcaagtaaaactggccatttttaactggaagtgcatggtggtaaagagtacaatgaccactggtacagtttttcatcactgccttgtttcttgccactgttttacttgttgcttttgcaccatcagtgcaaatgtcaaccttctggagaaaagcaaattatatcaaaactatggaaatagctttgactttgtagattgcctcatgagtctggaggactctcagggttcacgggtcacatggtgagaactgctgctttagataggtgccagcaagcaaatacagcaaaacaaggaaaataactaggaggagaaaaaaggagacaaagggtcatttgttgaagataggatgtctacccatagtggtttagcacaagataa

SEQ ID NO: 60681 - DNA, 142 bp, Homo sapiens
ccctctccaggaaccccaggacctccccaccatgcaaccaccaaagggtgacaggaacagggggctccagcacccacacggtggaggaatcagttctgattgtgaaggctctcaacccactgaatactgaatattttgaaca

SEQ ID NO: 60682 - DNA, 440 bp, Homo sapiens
attaacagaagtgcaaggagctcctgttggacctgtgttccatgaggaaggctttcactagcccttcatgataggttcaaacacttgaagacctgaggaatttcagagttgacatttagatattgaggtaacaggacatcttggagttgaaatttccagaatctttgctggaaagtctcataatctcaaaacaaaatcaagcaaatttggagcaaagaaagttgctgaaaatgtcaaggcatgaaatccaaggtgagtctgacctaaatgagtgagttaggcaaaggtgcatgtgaagatggactgggtacattttccaggtacaagagagggtctttgcagcaggcaaaagagattaggaaaacaaaatctgaagtaaagcctaagaaatagttaatgaaatcaactaactgagcttatgagctaattttttctttgtc

SEQ ID NO: 60683 - DNA, 563 bp, Homo sapiens
tgtctttgtatatcaaattgaaatacaaatgaaattggtcatttgtacatctgcaaatgtggatcgcgaatcctgcgagaagtagcctactgtgacaaagctgcctatgcctttatcactttgcaaaaacagaaaggtgggacacgttggtagcaatccctaaccctgtcataaacagaccttaaagaaactggccataaacaggatttctgcagcaatgggacatgctcatgatggctgtcatgcacactgctaaaagttgttggtttactagagcagggcaaggaacacctggccccgcccggagcaaaaaactgctcaaaccacaaacgatagcaggaaaggcctgtggcttgacagcatgtttttgctacagataatcagccagagcctgtttctctgctcctcactgagattgctttgtttcccataaagaatgcttttagcgaatctacaatctatagaagcaatgcttatcactggctttctgtcaataaatgtgtgggtcaagctctgtttgtggctctcagctctgaaggctgtcagccccctaatccccactt

SEQ ID NO: 60684 - DNA, 278 bp, Homo sapiens
agtatcaagggataaaatatatttttaattttgtatttcacttgaaaattgtaaggaccattttataatgtattgcttgcaaaataagtcatggaagccctgaaaaattaatcaattcactaatcaaagaaacatatattaaagacctactatgcatgaggcaccatgctaattgctttgaagaagacaaagttgaattagacagggatccagtttacaagatatttacaatgcaaagggggatacaagacatataaaaggctatggaacttaaaaag

SEQ ID NO: 60685 - DNA, 300 bp, Homo sapiens
atatgagaaagcagagcaaaacagatgatgctctaaatgcaactgacacacttgctaaagacgttaggtgctccataaatgcttgttgaaatgctgtttgtcaacatttgttgtgaaaaattcatctctttctctaagaatcctcatgagttaaccacaatcagttctacataatttaacagaaaacatctggtggcacttttaaatgtttaaggacagcatttcacaaactatgcccgcccccagtcccactgcagcaggagaaaataaggctatggagaaaagcaagatgagttatca

SEQ ID NO: 60686 - DNA, 311 bp, Homo sapiens
tttcttgctttacaggttagtttaaaataacacgatctgcacccccataatttctaattaaccttttttcagaactaaataaacatcaaattagccatcagaatgaatctctacaagtaaggggaaatggaaaggtaaagcaacatttcagtaatacaagccaaaaagtatgtgcattaatgggaaaaatttttggaggaagctgttactgagaatgactttttctgtcagattcactaagaagttgcttggcttttatttgtgagaatattccattttgaaggcactatttttacactggttaattaaaa

SEQ ID NO: 60687 - DNA, 3767 bp, Homo sapiens
atcaagattaatatctgtagtaataggcagaacacttccagtgtggaattgcttcttttctttggtcaaacactaactttggcagaggatagacacagcttaggaagactgaattttaagtcttctgaattgtttttctggacttccaaatctcaagtgataagaccagcagaagcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaaaggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaaaaagtt

SEQ ID NO: 60688 - DNA, 745 bp, Homo sapiens
  misc_feature (203)..(203): n is a, c, g, or t
  misc_feature (215)..(215): n is a, c, g, or t
cttaagcgtgctggactcatgctcaagaagcagataactgggcggcaaacagtttgttactccgcagatggggttcaggcaatcctaaacttaatttagcttgtgtagctaatttgtttaacacatacccatgcctgcacaagccgaataataatgacatcgatatgaatttactggaaggagagagcaaggaagagagaacntttcggaactgnatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgttattgttctgatatgaaacaaagaatttagagtttcatgaagttatacgtgctctgtccccacaattctgattcagaccaaaatgtgttaagcttaatagcctttttacaagtttgctttaataaatttaaagatgaaggcaatccctctagtcagacactttatataactattttcatctttatcaagtcatagtacttaatgttctttgagatgtcctgtaaatgtattctttttttacaattggtataacgttctgaatgtttattggttatccactcatttattcaacagatatttatcaattacctaatacctatacagtgttatgcaggatgta

SEQ ID NO: 60689 - DNA, 3877 bp, Homo sapiens
agtcaattctccataggaacactatcaagtctttttccataaaagtcagataaaagaaagatcacatttcttgatattctttgaagcaactttatttttattgtcatgcttcatcctgcccgaatactgccaagtctttctcaggcacctggaatctgctcctcagcctctgttgtcctgggtctaatgtagagcaaaaggctgagaggaagctcttctattctccatcatcggtcttcagtggctacctgggaaacaccccttggcttagtcggcagattctctccgatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaaaggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaaaaagtt

SEQ ID NO: 60690 - DNA, 3650 bp, Homo sapiens
gcaggtacttggttctccagtgggagctgccctctcgaaggcaggacagcggtggcggcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaaaggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaaaaagtt

SEQ ID NO: 60691 - DNA, 3926 bp, Homo sapiens
agtcaattctccataggaacactatcaagtctttttccataaaagtcagataaaagaaagatcacatttcttgatattctttgaagcaactttatttttattgtcatgcttcatcctgcccgaatactgccaagtctttctcaggcacctggaatctgctcctcagcctctgttgtcctgggtctaatgtagagcaaaaggctgagaggaagctcttctattctccatcatcggtcttcagtggctacctgggaaacaccccttggcttagtcggcagattctctccgatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaaaggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagagcaagaacatatcttaatcttaagaaacaatcattcaaaatataaaaggttaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaaaaagtt

SEQ ID NO: 60692 - DNA, 142 bp, Homo sapiens
aggcaattgctacaggaacaaggccaggggcctactgtaatttagcctttgcaaacaaagctaaaaatatcaaaacatgatattatagcaacccctttgtctttttggtttccagtcattagaagcatgttttttgtcttgt

SEQ ID NO: 60693 - DNA, 1030 bp, Homo sapiens
agcgcccattggccagcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagaatcctcagagtgaaaacaccaacaggctccagtttgtgttttcagctgcctactagacctcactacctggatggcccacaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60694 - DNA, 832 bp, Homo sapiens
agcgcccattggccagcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60695 - DNA, 948 bp, Homo sapiens
agcgcccattggccagcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60696 - DNA, 568 bp, Homo sapiens
gcttcagtagtgtttcttttatttccctcttccagtttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60697 - DNA, 1005 bp, Homo sapiens
agcgcccattggccagcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagggctccagtttgtgttttcagctgcctactagacctcactacctggatggcccacaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60698 - DNA, 973 bp, Homo sapiens
agcgcccattggccagcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagaatcctcagagtgaaaacaccaacagtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60699 - DNA, 1356 bp, Homo sapiens
agcgcccattggccagcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagaatcctcagagtgaaaacaccaacaggctccagtttgtgttttcagctgcctactagacctcactacctggatggcccacagctctggagactggaaggtccaagatcaagatactacagatttgatttctggacgttgaacatggtgtaggagtagaaaagcaacagggacggaaggagagaacttaccccttcaagcccttttataaggcactaaatcccatcattgagggcagagtcctcatagcctaatcacctcctaaatgctccatttcttaatattgttgcactgaggattaagcttcaacatgaattctgaagaggacacaaacatccaaaccatagcagtcaatgccttagcccttgatgttgctatcaacctgagattcggggatcaaggaaggacaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60700 - DNA, 1331 bp, Homo sapiens
agcgcccattggccagcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagggctccagtttgtgttttcagctgcctactagacctcactacctggatggcccacagctctggagactggaaggtccaagatcaagatactacagatttgatttctggacgttgaacatggtgtaggagtagaaaagcaacagggacggaaggagagaacttaccccttcaagcccttttataaggcactaaatcccatcattgagggcagagtcctcatagcctaatcacctcctaaatgctccatttcttaatattgttgcactgaggattaagcttcaacatgaattctgaagaggacacaaacatccaaaccatagcagtcaatgccttagcccttgatgttgctatcaacctgagattcggggatcaaggaaggacaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60701 - DNA, 1515 bp, Homo sapiens
caaaccagctagcctagctgaagagaagagggaagggggaagaggccagagaaaggaggaggcagtcagatcttagacctgtcgctacagggacagcttgaaagaagtagcactaagaaagatcatccgagcagtccccagtacagcccccactttttggcagaggttgggtaaggcttatgcgcaccgtgcctccctacatgcaacatcatttgtgtcatagagggagataactctattcagactctgcatcttgcttatcctggctacaagttagggagcttagaaagtatatctattggtacccactgtgtagtctagaatggtgacgcacacaagatgggacaattaggctcaatcctggctttggagttcagggagtcaaaggccaacacctggggccatattttcagaataaggaatgtaaatgtattcctcacagctctggagactggaaggtccaagatcaagatactacagatttgatttctggacgttgaacatggtgtaggagtagaaaagcaacagggacggaaggagagaacttaccccttcaagcccttttataaggcactaaatcccatcattgagggcagagtcctcatagcctaatcacctcctaaatgctccatttcttaatattgttgcactgaggattaagcttcaacatgaattctgaagaggacacaaacatccaaaccatagcagtcaatgccttagcccttgatgttgctatcaacctgagattcggggatcaaggaaggacaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgctcagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccct

SEQ ID NO: 60702 - DNA, 246 bp, Homo sapiens
agaaggggctagtttaagagaccattggatttgagggaatagaggaagagaaagtttctgggttaggtgcctgccttagtctgtttgtgctgctgtaacaaaacacctaaaactgggtaatttataagtaacgtaaatgtattcctcacagctctggagactggaaggtccaagatcaagatactacagatttgatttctggacgttgaacatggtgtaggagtagaaaagcaacagggacggaag

SEQ ID NO: 60703 - DNA, 481 bp, Homo sapiens
attttaaaatatgttgtgtttaaattgctgtgggaactaacctgtaattgaaaggaagttcagggagtgagtatggtttaatgaatgtgagtggggccctgtagatacacctttgccagaatgtgccccagtgtgaaaagtaaactgacctatgaaaatctaagccaggcacagtggctcacacctgtaatcccagcatttgagaggccaaggtggaaggattgcttgaggcccagagtgtgaaaatctatttgccatgtcatgtcttatgactgagagggcttctggagacagtatctccagtttgtttgtttgaatgactgtagctatttcaagatatctatgttttctcatagaatgaagacaaacacagagatggtgtgtctaagaaacttcaaaaggtgtagacctcctgactgaagcatattggatttatttaatttttttcactgtagtaagtataaatatttaaaacactttt

SEQ ID NO: 60704 - DNA, 4447 bp, Homo sapiens
agaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60705 - DNA, 1060 bp, Homo sapiens
agaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaacaaacaagcgcaaccagcacagcacaaccgcgcgacacacagacctcagcacacacgaacacccgggggggggcgggtaccaattggcctaagggagcggatacaatcacgggcgcggataaacgtgtgatgggaaaacgtggtacaattatggctggcagatccttgggctggtataaaaagcgcggatggtcaaatgaccgtaggaggatgaagaaatgaagagggactgaaactatcggaggacatgaggggttgggacaatcggactgttctcttttagttgttggtgtttctattagtgagagagagagacaggtaggaagagcgagcaggggg

SEQ ID NO: 60706 - DNA, 850 bp, Homo sapiens
gaaagtcaaagaccaatggctacctcagaccatcccgtatccactcgtgggaggcccctgaatgaatctaaggccccaggggttgaactttactgagtagggagcgcagagtactagggacaaatttaccgcccgctttgaggaaagctgatgtgggagcagagagcaagatggatagcagcggccaatctaaacgggcaacgaagtgccacagagtgctgcacgtaggaatgcgagtgacaggtagggtcgtctattccaagtccctcctctcccctaataaactgccacatttcagaaaacacgaagactgctgaagccgtttccagccttcgctacgcattagcagagcaactcaacaagcctgggtgaaaggcttctcgaagaaattcagttatctctactgccagccaaacacggactgggcagctttcctcgggggctgctcggtaactgctgagccgggggcgcgctgaagccctgcagaagcccacacccgcttcaggaattccgtggatgttcccgacagaggtttattcccgcctatccctacaggcccacggcgctctttcctccaatcccacacccagtcgaaggcggggcagccgccccacccagcggccagccgggcggcccccagtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtaagccgtccgtccccgaaacccgcaaggccaccgactgcgca

SEQ ID NO: 60707 - DNA, 5012 bp, Homo sapiens
gaaagtcaaagaccaatggctacctcagaccatcccgtatccactcgtgggaggcccctgaatgaatctaaggccccaggggttgaactttactgagtagggagcgcagagtactagggacaaatttaccgcccgctttgaggaaagctgatgtgggagcagagagcaagatggatagcagcggccaatctaaacgggcaacgaagtgccacagagtgctgcacgtaggaatgcgagtgacaggtagggtcgtctattccaagtccctcctctcccctaataaactgccacatttcagaaaacacgaagactgctgaagccgtttccagccttcgctacgcattagcagagcaactcaacaagcctgggtgaaaggcttctcgaagaaattcagttatctctactgccagccaaacacggactgggcagctttcctcgggggctgctcggtaactgctgagccgggggcgcgctgaagccctgcagaagcccacacccgcttcaggaattccgtggatgttcccgacagaggtttattcccgcctatccctacaggcccacggcgctctttcctccaatcccacacccagtcgaaggcggggcagccgccccacccagcggccagccgggcggcccccagtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60708 - DNA, 4958 bp, Homo sapiens
gaaagtcaaagaccaatggctacctcagaccatcccgtatccactcgtgggaggcccctgaatgaatctaaggccccaggggttgaactttactgagtagggagcgcagagtactagggacaaatttaccgcccgctttgaggaaagctgatgtgggagcagagagcaagatggatagcagcggccaatctaaacgggcaacgaagtgccacagagtgctgcacgtaggaatgcgagtgacaggtagggtcgtctattccaagtccctcctctcccctaataaactgccacatttcagaaaacacgaagactgctgaagccgtttccagccttcgctacgcattagcagagcaactcaacaagcctgggtgaaaggcttctcgaagaaattcagttatctctactgccagccaaacacggactgggcagctttcctcgggggctgctcggtaactgctgagccgggggcgcgctgaagccctgcagaagcccacacccgcttcaggaattccgtggatgttcccgacagaggtttattcccgcctatccctacaggcccacggcgctctttcctccaatcccacacccagtcgaaggcggggcagccgccccacccagcggccagccgggcggcccccagtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaactggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60709 - DNA, 4375 bp, Homo sapiens
aggaaccctctcccgcgccggcctcgcgcccgcgtctgtcaggcagcgtgtggggctcggtgctcgcagcgctcgggtttcagtgggaatggacagacagatctgaagttgaaaattcttttcacaactcatgttcaactatgtgtgttgtcagaatgctcttaatgaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60710 - DNA, 4394 bp, Homo sapiens
agaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60711 - DNA, 3947 bp, Homo sapiens
agaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60712 - DNA, 4393 bp, Homo sapiens
agaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttcttctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60713 - DNA, 2988 bp, Homo sapiens
ctagaggatccgattgcattgtcttcccatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60714 - DNA, 2523 bp, Homo sapiens
accgcgctctgctcctgagaaatcgtcctctgacttccttaagtgataactgccctttctgtcattccccaagataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60715 - DNA, 3655 bp, Homo sapiens
  misc_feature (2536)..(2536): n is a, c, g, or t
agaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaatgtganacttgtgagaaggcatttgccaaaccaagccagctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60716 - DNA, 2544 bp, Homo sapiens
cggacgcgtgggtcgacccacgcgtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttcttctttctcattcaaggggggaaccacaccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60717 - DNA, 1863 bp, Homo sapiens
accgcgctctgctcctgagaaatcgtcctctgacttccttaagtgataactgccctttctgtcattccccaagataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60718 - DNA, 1270 bp, Homo sapiens
  misc_feature (14)..(14): n is a, c, g, or t
  misc_feature (17)..(17): n is a, c, g, or t
  misc_feature (25)..(26): n is a, c, g, or t
ccagtctggtacgnccncgaggtanngatatcgtcgatccacgcgctctcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60719 - DNA, 1259 bp, Homo sapiens
tattgctcaatcttgtcaattgggagtccaccagtaggttcactgagatgatatggacaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60720 - DNA, 2471 bp, Homo sapiens
agaggaggatccgggaagccggctgcggcgggaggagggaatgcgcgtgcgcgctggaccgcctcgtcccgttccgtcccaatcattgtaaacaggcagaggctgggcggggtgggaatggggcgcccgaggccggcctggggcgcagcgcaggaggcggctccggtggctgcggcggcagcgtgagcgcgaggaggcggaggctgcggcggggcggacggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagaaaaaaaaaaa

SEQ ID NO: 60721 - DNA, 8114 bp, Homo sapiens
  misc_feature (1019)..(1019): n is a, c, g, or t
gctctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcntttgccaacagtacatgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaatatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattaaggtcacgtcctatagtttgggggctcttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttgacattgccacagtttacagtgtcattcttccacgaataggtaattgatagagtttatgggtcttagtcttaagggtaacagagtgaataccttccaaataaaaagctaaatattcctccttgtcattttaatgtcattattgaaatacttttaattctaattttcaaaagaaagctaaatgctgattgtggtttaggatgttacagtactaataccatcatgttatttattctaatatagaggcattgagaggaggggagtgtatgtctagagttaccccaattctaaataggtaccaaaagagtattgattatgacctggagcctgagctttgggagaatatacaaaggaaaaagcaggcatagtttccactttaaagggaagaagggactttaacatcctatgaatttgaaacatcctatgaatttgaaagtttcctaagtgttgttttcaaagaactggtttattttatagtcagtcaaaatgcatttggaatgtaccttgcttccataacagactttgactctatgacctatgaagaataaaaagataatctgaaggtgtttgagtcagaggctacttttcccctttatattttatatagaagcctatttgtaattcttcctcttcgttcttcacctgggtttcctcttatctacccaccacctaggacagaggctgcccactcaggtcttgccttgttgcccctagatgttgccacattcacatctccttgatggccttagatctcttgactagtcaaggactgggaacgtgccagggggaacaaagtaagcttgatgggctggaacttttgactttgggtccccaaacagccaaaaacagatacagaaatctttggttgtgtggatgcctgtgttcagagtggccttatcttgacctcagttctggatttaagtactctatagaaaatttgtgaagtcagaccagaattttctttgtcccatgaggtgtctttgtaagtcagcatgctcttgcttgaacaccctgtgggtgaataactttagtaagttagctgccagcattagaaccttccaggaagaattttaactagtatgctacatttgaagcactctgacatgtacatttaaagtgacagttttaaaagtaaaatggtgttaaatctctgaaacttgaacgtatgatgctctggacattttaggaagcttaagtaaatttctgattttcctttattgattatgtaacccacgtgatttgcatattttagtttttatgtttgacagtggtacaaatgactgacattggcaggcagttattgtagggtatatggttaatcacgattgtctaacttttccagagaaagtggtgatatgcttcttccttgcatggagctgtgggaattggatttgttggctcttcatttccagtgtttctacagtgcagaataaatgtaactttttaagcctgcatgctagtaatatgctttgctctttagtaaacaaatatgcaatagatagtaatctatctactttttttaaagcagggatctgctccctatctagacagatcttttaatgcattaatatttagagtagcaaaagaagttttgccatttgtagctctctcacaggtagcttaagcgagggggttgtgttgcatgtgcttagaaaggccaggttcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctgtgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttttcagattgtct

SEQ ID NO: 60722 - DNA, 490 bp, Homo sapiens
gctctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagcccccgaaaggatggagttccttctgttgtgtcaatcgccttcattttagtgaagtttccactcgcctgtcatgcatacaacttcggaggaggagatgatcgtttggcagatgaggcccgggaggggagcgacttgccgatgccatcctgctgatgtctccacttctgctcccggcagggacttcctaagcggcagcttgtggcgctagggccaccagatgaaagggaggtgcacaggaaggagctgtggagtggaaagagcgcgggctttcgagcacatacaaacctgattacaaaagtcagatttcttt

SEQ ID NO: 60723 - DNA, 7701 bp, Homo sapiens
gctctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaatatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattaaggtcacgtcctatagtttgggggctcttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttgacattgccacagtttacagtgtcattcttccacgaataggtaattgatagagtttatgggtcttagtcttaagggtaacagagtgaataccttccaaataaaaagctaaatattcctccttgtcattttaatgtcattattgaaatacttttaattctaattttcaaaagaaagctaaatgctgattgtggtttaggatgttacagtactaataccatcatgttatttattctaatatagaggcattgagaggaggggagtgtatgtctagagttaccccaattctaaataggtaccaaaagagtattgattatgacctggagcctgagctttgggagaatatacaaaggaaaaagcaggcatagtttccactttaaagggaagaagggactttaacatcctatgaatttgaaacatcctatgaatttgaaagtttcctaagtgttgttttcaaagaactggtttattttatagtcagtcaaaatgcatttggaatgtaccttgcttccataacagactttgactctatgacctatgaagaataaaaagataatctgaaggtgtttgagtcagaggctacttttcccctttatattttatatagaagcctatttgtaattcttcctcttcgttcttcacctgggtttcctcttatctacccaccacctaggacagaggctgcccactcaggtcttgccttgttgcccctagatgttgccacattcacatctccttgatggccttagatctcttgactagtcaaggactgggaacgtgccagggggaacaaagtaagcttgatgggctggaacttttgactttgggtccccaaacagccaaaaacagatacagaaatctttggttgtgtggatgcctgtgttcagagtggccttatcttgacctcagttctggatttaagtactctatagaaaatttgtgaagtcagaccagaattttctttgtcccatgaggtgtctttgtaagtcagcatgctcttgcttgaacaccctgtgggtgaataactttagtaagttagctgccagcattagaaccttccaggaagaattttaactagtatgctacatttgaagcactctgacatgtacatttaaagtgacagttttaaaagtaaaatggtgttaaatctctgaaacttgaacgtatgatgctctggacattttaggaagcttaagtaaatttctgattttcctttattgattatgtaacccacgtgatttgcatattttagtttttatgtttgacagtggtacaaatgactgacattggcaggcagttattgtagggtatatggttaatcacgattgtctaacttttccagagaaagtggtgatatgcttcttccttgcatggagctgtgggaattggatttgttggctcttcatttccagtgtttctacagtgcagaataaatgtaactttttaagcctgcatgctagtaatatgctttgctctttagtaaacaaatatgcaatagatagtaatctatctactttttttaaagcagggatctgctccctatctagacagatcttttaatgcattaatatttagagtagcaaaagaagttttgccatttgtagctctctcacaggtagcttaagcgagggggttgtgttgcatgtgcttagaaaggccaggttcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctgtgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttttcagattgtct

SEQ ID NO: 60724 - DNA, 8047 bp, Homo sapiens
  misc_feature (952)..(952): n is a, c, g, or t
ttaaacaatgggctaatgatcgatgccgtggtttgaatgcaggtgtgttaagctgtagcggatgtgcgatgcgtcatcgggtcgtcatgtgacgatcgtaccacatgtgtgatagtacagtaagttgtatacctcactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcntttgccaacagtacatgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaatatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattaaggtcacgtcctatagtttgggggctcttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttgacattgccacagtttacagtgtcattcttccacgaataggtaattgatagagtttatgggtcttagtcttaagggtaacagagtgaataccttccaaataaaaagctaaatattcctccttgtcattttaatgtcattattgaaatacttttaattctaattttcaaaagaaagctaaatgctgattgtggtttaggatgttacagtactaataccatcatgttatttattctaatatagaggcattgagaggaggggagtgtatgtctagagttaccccaattctaaataggtaccaaaagagtattgattatgacctggagcctgagctttgggagaatatacaaaggaaaaagcaggcatagtttccactttaaagggaagaagggactttaacatcctatgaatttgaaacatcctatgaatttgaaagtttcctaagtgttgttttcaaagaactggtttattttatagtcagtcaaaatgcatttggaatgtaccttgcttccataacagactttgactctatgacctatgaagaataaaaagataatctgaaggtgtttgagtcagaggctacttttcccctttatattttatatagaagcctatttgtaattcttcctcttcgttcttcacctgggtttcctcttatctacccaccacctaggacagaggctgcccactcaggtcttgccttgttgcccctagatgttgccacattcacatctccttgatggccttagatctcttgactagtcaaggactgggaacgtgccagggggaacaaagtaagcttgatgggctggaacttttgactttgggtccccaaacagccaaaaacagatacagaaatctttggttgtgtggatgcctgtgttcagagtggccttatcttgacctcagttctggatttaagtactctatagaaaatttgtgaagtcagaccagaattttctttgtcccatgaggtgtctttgtaagtcagcatgctcttgcttgaacaccctgtgggtgaataactttagtaagttagctgccagcattagaaccttccaggaagaattttaactagtatgctacatttgaagcactctgacatgtacatttaaagtgacagttttaaaagtaaaatggtgttaaatctctgaaacttgaacgtatgatgctctggacattttaggaagcttaagtaaatttctgattttcctttattgattatgtaacccacgtgatttgcatattttagtttttatgtttgacagtggtacaaatgactgacattggcaggcagttattgtagggtatatggttaatcacgattgtctaacttttccagagaaagtggtgatatgcttcttccttgcatggagctgtgggaattggatttgttggctcttcatttccagtgtttctacagtgcagaataaatgtaactttttaagcctgcatgctagtaatatgctttgctctttagtaaacaaatatgcaatagatagtaatctatctactttttttaaagcagggatctgctccctatctagacagatcttttaatgcattaatatttagagtagcaaaagaagttttgccatttgtagctctctcacaggtagcttaagcgagggggttgtgttgcatgtgcttagaaaggccaggttcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctgtgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttttcagattgtct

SEQ ID NO: 60725 - DNA, 8060 bp, Homo sapiens
  misc_feature (1019)..(1019): n is a, c, g, or t
gctctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcntttgccaacagtacatgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaatatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattaaggtcacgtcctatagtttgggggctcttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttgacattgccacagtttacagtgtcattcttccacgaataggtaattgatagagtttatgggtcttagtcttaagggtaacagagtgaataccttccaaataaaaagctaaatattcctccttgtcattttaatgtcattattgaaatacttttaattctaattttcaaaagaaagctaaatgctgattgtggtttaggatgttacagtactaataccatcatgttatttattctaatatagaggcattgagaggaggggagtgtatgtctagagttaccccaattctaaataggtaccaaaagagtattgattatgacctggagcctgagctttgggagaatatacaaaggaaaaagcaggcatagtttccactttaaagggaagaagggactttaacatcctatgaatttgaaacatcctatgaatttgaaagtttcctaagtgttgttttcaaagaactggtttattttatagtcagtcaaaatgcatttggaatgtaccttgcttccataacagactttgactctatgacctatgaagaataaaaagataatctgaaggtgtttgagtcagaggctacttttcccctttatattttatatagaagcctatttgtaattcttcctcttcgttcttcacctgggtttcctcttatctacccaccacctaggacagaggctgcccactcaggtcttgccttgttgcccctagatgttgccacattcacatctccttgatggccttagatctcttgactagtcaaggactgggaacgtgccagggggaacaaagtaagcttgatgggctggaacttttgactttgggtccccaaacagccaaaaacagatacagaaatctttggttgtgtggatgcctgtgttcagagtggccttatcttgacctcagttctggatttaagtactctatagaaaatttgtgaagtcagaccagaattttctttgtcccatgaggtgtctttgtaagtcagcatgctcttgcttgaacaccctgtgggtgaataactttagtaagttagctgccagcattagaaccttccaggaagaattttaactagtatgctacatttgaagcactctgacatgtacatttaaagtgacagttttaaaagtaaaatggtgttaaatctctgaaacttgaacgtatgatgctctggacattttaggaagcttaagtaaatttctgattttcctttattgattatgtaacccacgtgatttgcatattttagtttttatgtttgacagtggtacaaatgactgacattggcaggcagttattgtagggtatatggttaatcacgattgtctaacttttccagagaaagtggtgatatgcttcttccttgcatggagctgtgggaattggatttgttggctcttcatttccagtgtttctacagtgcagaataaatgtaactttttaagcctgcatgctagtaatatgctttgctctttagtaaacaaatatgcaatagatagtaatctatctactttttttaaagcagggatctgctccctatctagacagatcttttaatgcattaatatttagagtagcaaaagaagttttgccatttgtagctctctcacaggtagcttaagcgagggggttgtgttgcatgtgcttagaaaggccaggttcccagaattggaaggtgccacatatacttttagaatattttaacaaaggcttgtctctaggaaaatccacttggactgcagcaggattgttctggtcttccacagaccattcacatggtctttctctccagagaatcattcttagaaagccaggctaaatcagagtagtgctgtttttaaagcaagtatattggatgatggctatagggtaccttaatgctgtgttgaaattggaagcagactgctcttcagcagcacatatactgcaactgaagttagagacagtactgaagacgagggagtagctaaatgctgtggatatttcatgtctgtttggctaatgtcttctcttgaggagtttctatgggtagcaattaaaattagaatttattttaaggtttttattaaaatatatacaatttgccataaattctagattctgatattcttgacaagcactttttgaatatctcaagagtaagttcttgacctggaacatatatagttagtacttgatgtcactaaccaagttgtagaaggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagagtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttttcagattgtct

SEQ ID NO: 60726 - DNA, 989 bp, Homo sapiens
gctgaggtgatctagaggatcccagttcgacggagactctccccaataacgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagcctcttcctgatctggagccacagtctgtctgtcttccagttcatctcagtcctcgagaaaggccctttaaatatgtcactttcccattttcctttaaccatgggttgtgtgagccagaaagagctttgagaaagatggctgcttccaccagggtggaggcttctaggtctgcatgatgatggggcccgtttctggccagagggtggctctgggagcagttgtgctgcgggcttgctgggggagaactctaactgttgcagaaacagagcttcatggcttgcttaaattacttagctggaatattttaaagtgtcagataatgtgatgtacaaagagagtatgccgatgcatttcattgtttttgcattatctgtatcagtgtttcccattgctagcccgaataatcaagaccagactgtttcttgtcactggattctggaagccttgccctttcaactggatttatgtttgtttctgctgctgtgaaaccccaaagtaatgcagtaggttttaattgaaaattgtttaattctattattgataattatttattgtaataaaagtaaaagagtaatttttaaatccttttaattgttttcagattgtct

SEQ ID NO: 60727 - DNA, 4086 bp, Homo sapiens
  misc_feature (1019)..(1019): n is a, c, g, or t
gctctcctaccttctcgggcagcccagtctttgccatccttgcccagccggtgtggtgcttgtgtgtcacagccttgtagccgggagtcgctgccgagtgggcgctcagttttcgggtcgtcatggctggctacgaatacgtgagcccggagcagctggctggctttgataagtacaagtacagtgctgtggataccaatccactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtgactatttcttttgtctacatagtgactgcagttgtgggagttgaggcctggtatgaacctttcctgtttaatttcttatatagagacctattcactgcaatgattattggttgtgcattatgtgtgactcttccaatgagtttattaaactttttcagaagctataaaaataacaccttgaaactcaattcagtctatgaagctatggttcccttattttctccatgcttgctgttcattttgtctacagcgtggatcctttggtcaccttcagatattttagagctacatcctagagtattctactttatggttggaacagcntttgccaacagtacatgtcagctgattgtttgccaaatgagtagtacccggtgtccaactttgaattggttgctggttcctctcttcttggttgtcttagtggtaaacctaggagtagcctcttacgttgagagcattctcctgtatacattaacaactgcttttactctggcccacatccattatggagtacgagtggtaaagcagctgagcagccattttcagatttaccccttctcattgaggaaaccaaactcagattgactaggaatggaagaaaagaatattggcctgtaataatctttctttgggcacaaagaagtactgtaaataaatgcttgtaaatatttcctccatcaccattgaactagactgatctgcttgacagacgtgggatctcagtatggtacttggacagcaggaatgatacatataatctgaacttgggaaattttggacctactaactctaagcctattttattttttataaaactatgtgacattttggttgagcagaatgtacgttagaccagcaaaatgttcctaatggttctaacttcgtgagtttacaatgttgtgattcatgcagggttaaagatgctttgtttttattttttaagtaccaaaattggtttcagaacactgataacactcagaaaaccacagtgtgttttcatatttggaactttgtaatagcgggagtagcagtagtccaaacctagtatagggaaaggataaaaataagtcaccttcaccaagagatgccaatgattaccaaacaacagacagttgccaaatactggtttctctttcccctgaaaatggcttttgttctcaaatgataagagagctaatacatttagctaatattctagctctctttattatggaacagatcttgatagatggtttaattttctcctaaagagaaataatcagttgagaatttgagaatgggttgtaattatcgctcacccattgggatggttcattgtttaaatatggcattttccccccttcagctgcaggttcctgagatttggtgcctgtgagctctgattgtaggaatgcatgtgacagtcccagtcctatggtaatgacttaggaggaatgcagataaaagtaccttgtaagataaatataaattggagttaggaatttcatgaacctcactatgaccaaaattaattttttgattcagtttgtctgtctgtctgtccttcccctctcttcttttttcagggtgaggtgctgtgtttcttatttcatacgagataaaacagagagaagttctctcttctccagcttgtccatttccccacttgaagaaaacttttgatatatatgccttactgagtacatgccccctttaatgttaatatgacttggagtaatttctgaggtttactgacaaacataaaaatccctttaattgtagtgtagttgttctataaaccatattttttcatgatgtggatattttcttctatttctttgtcttcatttaatttggtggtggtgaactttacttgctgattttcttttatttttcactgaatgaagtttgtgcttgaatgaagagtgtatcttaaaccccctttttttggacaggctgcacttggataaaataggcaccactgtgttgatatgtaattaaattcataactatttatgaatgtgaccattgttaaatttaattatagtgtatttctttcttgaatttcagtctgctgctttgtaaaaaataactgtaattgatatttcatttttaaaatttataaattccaatcattgtcattcaagttattagaaatgagtcacggcactaactcatggttctatactcattttaagaaattgtaaaggttgaggtgtatttggtgactttctctgagacacagatgaacgttggaaatagatgagaaatggatgcagaataatgcagatagtgatcccatgtttgttaattgccatcatggaagtcagagaattaaccaattaagtgacggtaactattttttgtataccttgttctttgtgatctataaaattaaactggataaaatgttaattgggggtagggaaaaagctttgttttaagatttctaagctaattattttaccgttttgttgaccttgtacacaagaatgagattaatctgtattatataagaaaagaactgataaatatttataaaatgacaaacttggaccacaggctttcttgaccttgtacagtatagtaaaaataccctttacttctgacattaaggtcacgtcctatagtttgggggctcttttacttcaaaggtgtgtttctgccctcttttggttgtatcaaatttatttgaaaattgttttgtgctgtactttatgacttgtttccctatggtggtaaagaatgatgccatagtcagttttattgacattgttagatgaaagaaaagtagctgtcaacaaggggaaagtgaaattgagcaattcactgtttcaggatacttgaggatctttagtgtactgctgactctttttcttgttttgtctgccattcttgaaagtgcatcttgagagcccccatttgttgtgtagagatatagcagctgaagcaggacttcattccagatagctgtgtgcatttatgtcatgccaattactataacatttccaaagtatgaaaggtctttcaggcttatgcatgatattgtgggtgacttcatgccccagcctttctccccagcatacagtgagctgccttttggggagcaatgccatgataaggagcatacgtgcatgttttccgtactttcagaatagagtgccttagctaggccagaggctcgtattgtgtttctgctgaccaaagttgcatacacctgtaagaagtgtctttttaggttatggtattaaaaaaagtcgtttcaggcttatcagataataattctcctatatttgaggggggcatgggataaaaagatttaataatacctggatagagaatgctaatgctgccttttgtgatcctttaatattatccatgcttttataaagtgcagtacacattttga

SEQ ID NO: 60728 - DNA, 1504 bp, Homo sapiens
ttaaacaatgggctaatgatcgatgccgtggtttgaatgcaggtgtgttaagctgtagcggatgtgcgatgcgtcatcgggtcgtcatgtgacgatcgtaccacatgtgtgatagtacagtaagttgtatacctcactttctctgtatgtcatgcatccattctggaacactatagtaaaggtatttcctacttggctggcgcccaatctgataactttttctggctttctgctggtcgtattcaattttctgctaatggcatactttgatcctgacttttatgcctcagcaccaggtcacaagcacgtgcctgactgggtttggattgtagtgggcatcctcaacttcgtagcctacactctagatggtgtggacggaaagcaagctcgcagaaccaattctagcactcccttaggggagctttttgatcatggcctggatagttggtcatgtgtttactttgttgtgactgtttattccatctttggaagaggatcaactggtgtcagtgtttttgttctttatctcctgctatgggtagttttgttttctttcatcctgtcccactgggaaaagtataacacagggattcttttcctgccatggggatatgacattagccaggtggtaagtatgtgttctaccttaaattttcagtattaccatgatacttttggaaagcttttgtcattgcttatttattgctcttaggcttttttgattagaattgatatgtacttaaaaattttttatttttatttatggaaaatttcaaaaatagaatagtatagtgaatagtaaagtagagagaatatttaggaaaaagtagagagaatagaccctaatgtacccattgctgaggctgaggcctcccgagtagctgagattacaggtgcccactatcacgcctggctaatttttatatttttagtagagacagggtttcactatgttggctgggctggtctctaactcctgacctcaagtgatcttcctgccttggcttcccgaagtgttaggattacaggcatgagccaccgtgctcgacccttctcaattattttaaaggaaatttctgatattatatgataaatacttcgctatatatctctaaatgataaaagcttcctttaaaaaaacaatcacaatgccagtattacaccaaaaatttaaccatttcttaatgttattgcatgttcatttgaactcttgattttggaaagaaagatatgcacatataattgaatggttggctttttgtgttcattgccaccttttcagtgtgtagagagatttcttttttcttactttaatggccttgctattaactctccctgccttgaatcccagctttttgtgttgccattttgcccatttgcacctaagtctccagtaaagaaatcagaagttggagtgtttgttgaagtggttgggtgggtaaatttggatcatcttacaacttaaccaatttatgagttgctgttaaagtgctccaaatgatgg

SEQ ID NO: 60729 - DNA, 383 bp, Homo sapiens
gcgtggctccgggcgggctggcgggcgttcctccggaggtcctgcgggtcctggggattgggggtcggggagcgtgggagcatcctaagcccgccgcccgtagtcggcaccccccgggagatttccttttccttaggagagcgctcagtgatcatggagcgagggaattcccttcctattttttttaaacttattattttcgtaagcccccgaaaggatggagttccttctgttgtgtcaatcgccttcattttagtgaagtttccactcgcctgtcatgcatacaacttcggaggaggagatgatcgtttggcagatgaggcccgggaggggagcgacttgccgatgccatcctgctgatgtctccacttctgctcccggca

SEQ ID NO: 60730 - DNA, 369 bp, Homo sapiens
ctccccaacaggcttaaagaaagaatccatcagcttcacagaaatgtcctttgagctcatgtggagcaaaggcagacgccttgttatacttcctgcccatgtggaaactctgatgggtcttgttttcccatctctcttcctatcttgtgtagttaacttgcacaccctccttagcaaactgcacaactttttaggataaataaaagtcctctttgtacttggcaaaagtcaagctgcctgccatagcctttgtatagaacacaggaaggggatgaccagtcagccgacaagcactgtacttcttgacaactgtccacgtattcaggtgtaaaatgatgatatggaaattcaaaggacgctatgtgggaa

SEQ ID NO: 60731 - DNA, 2955 bp, Homo sapiens
  misc_feature (914)..(914): n is a, c, g, or t
  misc_feature (1628)..(1628): n is a, c, g, or t
ctcttcagccagagacccctcagcccaggaggagtgaggccgggccagcagcgggggcccgggaagccccatgtcttgggacctgctggggcagggccccctggatgtcaggctgcaggtccggcagctggggaggggatgagggcctcccaccagctctgcccatcagccagatccctgggagaggcagcacttgctggccacagagtcggccccagtctcacctggctcccctcccccaccagctgggccctgcactgccccagcccacgcggcgcctcacccctccttgacagaacagtatctctgggacggacaagttaatccaagacccacagtagccctggatcccctgggagaggtggctgcccagctccagggccagcttggaggagccaacttcaaaagcctccgcctggcctgcccctctgcagtcctccaggcagcctgtccagggaagcggttggctggtgttggacctggtgcggcagtgcacaccctgcccaaggaccccaggatcatgtgcgtggcctgctggcgggagtgagggagggcaagaccctgaaaggcccatggtgagcagctgtgggcctcctctagggagggggcttacttgggtggaggggctgggggtacacacagctcaggagacactgcttgttcccctgagccccaccaggaaatctccggttggctctggtcactgcgtccctgtgggtggcactgggtgcatgtgccctggcttctggcagttgggggaggggggctcctgggtgccgggcaaccctgttctaagctgggctgaggcttgagcctggaagtggtactaacaggccagttgggactcccagggcagccagtctgccccacctgggtgggacacagcaggtgctggacatccttgcagctccagntggcctgctcaggagtcaggctctggttctcgctatgacctctgacccagagcaggcagagggaatgacgtggcaattctgagcccaccaagttggctgtggcgtgtgtggttgggggggtcaggtttcaggaaggggccacagcaagccatctgctcttccagccattgctgctttgtgctctgagcaggagctgccaccgcccaccaggcccccagctctatgcaagggttggggtgctgcttgttcaggctcccctgacagggctaggaagccgagtcgagtcctcttatcttggttgggttcgcatgattaatttccagccctagatctgctgtctgactccatcctgggggcccaggggaagggttggggctggccccttttgggtggctgggaacctgggggccgtcagctgtctccttgatgtttgggctttatccctgcgggcgcaggccctccattttgggtcgggggaggcctgtggcacaggctgcccggagggatggcgtggggcggctggtacaggcagaggggccttttgcgactgttggttggggctggatgtggtggctccttcctcctctatagcttctgggtgtccccctagctttccccttccaatagggtgtggcttggagctctgagcccctgccccagttgggttgggggtacaaggagtccccagttcccacgtctctgtgagctaacccngagggcgccagtatgggaggtgtggagttgaatgggcatggccatgagtgagacaggctgtactgggacaacttcctactgtacccccaagagcctgcagaccagccccactagagctgtacggggctggtggggggccctgctctgtgcggtcctgagggtgctccaccccttgctggccccactcccacgtggaccacagagccaggctctcctgactctgggcctgccccctctatctcctgatgggttcttcaggactcagtgacatcgcctcccagccgacatcactcacccctttcacatctttgcagggagcatagaactgtctggtttgcagacctatctcttgtgtctcctgatttatcccgccaggcctgtgcctacagcctttcttgattggtgacacgtccatttcattcgctcagagatcccgtggggtggggcagggggtggggcttctacggaaacaaagtgcaggtgggctggctgctccctgtgctgggaacaccccccaggcctaaccccaacctgctgtctcctccaggtaccccctaagcctgcactctgggcgctcctgctggcgctgctggggaccgcgccaagccgcgcctattccccggcctgcagcgtccccgacgtgctccgccactatcgcgccatcatcttcgaggatctgcaggccgccgtgaagtggggcggggcgggggccgaaaagaccaggccaggctccagacactttcatttcatacagaaaaacctgactagacccgggagctcgggacggcggggacggcctcgggcctcctgtggcgcccagaagggccgccgcgcgtcccggggctccacggccctaggctgaagtcgggctgggtcgcgtctcccttcccgggccgggccgggcgcgggggccgtgcgcattcgctgaccgccctgtccccgacagcggagccggcggcccaagatgcgccctgcccggcgtcgcggcggccgaaggcagctcctgctgcgcgccctggacgccgtcgccacctgctgggagaagctcttcgcgctgcgcgccccggcctccagggactcctagcgcggcccgtcctggccctgcgcggggaggagaaccagcggggccgcggtagagcctggagacgcgcctcgttctgtagacttgttggtgacctcggcccctcgctcgacgcagcccgcgctccccggagggcccaggacttggagaagggagcgcgcctggccgccgctgggtcacggaggaggcccgccctccacgcgccgaaggcctcaataaacggagctggcgctgcgggtccggcaa

SEQ ID NO: 60732 - DNA, 311 bp, Homo sapiens
caggtaccccctaagcctgcactctgggcgctcctgctggcgctgctggggaccgcgccaagccgcgcctattccccggcctgcagcgtccccgacgtgctccgccactatcgcgccatcatcttcgaggatctgcaggccgccgtgaagtggggcggggcgggggccgaaaagaccaggccaggctccagacactttcatttcatacagaaaaacctgactagacccgggagctcgggacggcggggacggcctcgggcctcctgtggcgcccagaaggtatggaggaggcgcccctacccaagctcgcc

SEQ ID NO: 60733 - DNA, 601 bp, Homo sapiens
catcgccggggagcccgccaggtggaccggcccgcgctccgcccccagcgagccggggacccacccaccaccccccgcaccgccgacgccgcctcgttcgtccggcccagcctgaccaatgccgcggtggaaacgggcttggagctggccccataagggctggcggcttcctccgacgccgcccctccccacagcttctcgactgcagtggggcggggggcaccaacacttggagatttttccggaggggagaggattttctaagggcacagagaatccattttctacacattaacttgagctgctggagggacactgctggcaaacggagacctatttttgtacaaagaacccttgacctggggcgtaataaagatgacctggacccctgcccccactatctggagttttccatgctggccaagatctggacacgagcagtccctgaggggcggggtccctggcgtgaggcccccgtgacagcccaccctggggtgggtttgtgggcactgctgctctgctagggagaagcctgtgtggggcacacctcttcaagggagcgtgaactttataaataaatcagttctgtttaccaaaaaaa

SEQ ID NO: 60734 - DNA, 527 bp, Homo sapiens
gattcaaacctgactccattaggtgctgctcattgccttggaggctgctgctcctgtgtgtcagatccacagagatatccgagtttagaaatgagtggaaaaatacccatggtgggcaggaagagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccaggaagtcaccatggacaggccacacagaaattacagggagctatggttcttcaccttgaagaaaggaggatgatgaggagggctaaatcaaaaacaactatgaaaactcctatcctgttcatcaattgcacaaatagactgaataacagccatcctaacctacagtgtactatattggtcagctttcattacgttatgataataaatcacatcactcccaaa

SEQ ID NO: 60735 - DNA, 856 bp, Homo sapiens
acccagcgagagtgctccagctcccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggacgaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttctggaacaacttggttaaaaaggcctaactgggcacactcagtaaatcctgttcaccttggaggctcagggcatacacatcagtagacacacaagacctaagggccagcccttgagcagtcccagaa

SEQ ID NO: 60736 - DNA, 821 bp, Homo sapiens
acccagcgagagtgctccagctcccgcggaggaggctgcgggcggcgccccgggatagggaccctgcagctccagggagttgaacttgtcaaattaatgtctacagtgatatgtatgaaacaaagggacgaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccaggaagtcaccatggacaggccacacagaaattacagggagctatggttcttcaccttgaagagtaaaatagccactatgaggagacctgctgtgagtgcatcagtctgaaactgctcacatattaacgctgactcagacccatgaagtcatcagatgtcaccactcctagaagccctttcctgcacttcctggctcctcaggtttcctgcttcatcctgcacctgccttcttgaaagaaaacaagacatcagatacttattcaaataatggaatagctgatcaactgggtctccacacaaaagagagttatccatgataaaagaacaactttttcatgcattatatgtgacacatgcatgctttctcttaagatttatgaacccatgactattagtattgttaatataatcaaaccttttacagcctcactccaaagcttaaacttattatcaattgccttctagag

SEQ ID NO: 60737 - DNA, 951 bp, Homo sapiens
acccagcgagagtgctccagctcccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggacgaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccaggaccatttcactgacctgaaaggatatatttaaatgtgcctgtccaatttactacctaagagataatgaagtttttaggacaactgataaagcagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttctggaacaacttggttaaaaaggcctaactgggcacactcagtaaatcctgttcaccttggaggctcagggcatacacatcagtagacacacaagacctaagggccagcccttgagcagtcccagaa

SEQ ID NO: 60738 - DNA, 447 bp, Homo sapiens
acccagcgagagtgctccagctcccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggacgaagaattcttgctaaccatcagaccttttgcaaacaggatgcagaaatccccttgctatattcccattgtgagcagtgccaccctgtgggatagaagcacacccagtgcaaagatcaagctattgaagcttagggaggtgaagtaattttcctgggatcacatagccagtaaatggtagagg

SEQ ID NO: 60739 - DNA, 653 bp, Homo sapiens
acccagcgagagtgctccagctcccgcggaggaggctgcgggcggcgccccgggatagggaccctgcagctccaggtagacgcagggagcgcgggactcgccccctggcagggtgaggtagagccggaccgtttgctctctgctgctccccgggactccagccgcgcccgtgagaagaggcagcacggcagcaaaggccaaggagcggagggagttgaacttgtcaaattaatgtctacagtgatatgtatgaaacaaagggacgaagaattcttgctaaccatcagaccttttgcaaacaggatgcagaaatccccttgctatattcccattgtgagcagtgccaccctgtgggatagaagcacacccagtgcaaagcctctagtattcatcatcctggaatgcaaacaaatttgactcaacaatttccaccaaggtcctgagccccacttgcctcaaaaccagtagacctggtctggatgcactctcccaagaaacttgccaactaatgaccaaggatctaaaataatggtgtccaaattttaattgcaaatgtctagcaatgataaaaaatttagtgcccatatctcatatacttatagacagatatgtactactccattcattaaaatgttagaaactagattataatg

SEQ ID NO: 60740 - DNA, 277 bp, Homo sapiens
gtgatccaccgacctcggcctcccaaagtgctgggattacaggcatgagctatcacgcccagctgcaatattttaaatatattttagtataaagtgaagggcctctgacgtccatctagtaagaatcgggccacatattcatagactgacagtttcaatctttgcagactttgtcctttgaagtttgctttgctttctcttttcacactttggtagcatctttcagttctctgctgctccagagaggaacattatggcctcttgattggatggataa

SEQ ID NO: 60741 - DNA, 255 bp, Homo sapiens
gatgagagtatagattttgaagtcatctggacctgggttcaaatcttgtcccatttacttatagtgtgatcttgggaaactgggaatgtaacactcttggcttcagtttcctccttgaagggttaatgggaggattagatataaaaataaaagatgtgtaaaatacctaccccatgacttggcacgtggtaagtcttgaaccccaagatgtgtatgtgtagacctcagtccttcagttttagctggacttctgag

SEQ ID NO: 60742 - DNA, 626 bp, Homo sapiens
gcagtggtgtgatcatagctcactgcagccttgacctcgtgggctcaagcgattctccccctctcagcctcccgagtacctgggaccacagacccgtgccaccatgcctggctaattaaaaaaaatttttttttgtagagatgggatctcgctatgttgcccaggctggtcttgaacttcccagttcaagcaatcctcctgccttggcctcttaaagtgttgggattacaggtgtgagccaccttgcctggcccagatgattttgtaatgaggaggcagcttggggtctagaaagccagggccttagcaaggcagggatgggatctgttttgatgcctgctgtatccccagtgcctctgtggtctcttctgcaaagcaggcaacctggccagtaccaggtgggaatgacgaataggcacaggtcgctggctcaggacactggggtttggttacaagcttctgccccaggacagctggtgctccataaatgctcgttgagccactgaatgggtgttaacacctgaatcccagaagctgtagcaggctgtgtgtgtttgtgacgatggcagggtgccctggcatttggagggcgatgcccctaggccccaggcagtccctaggaaggc

SEQ ID NO: 60743 - DNA, 435 bp, Homo sapiens
aaagtatatatataaaagaagacctgggaataatagttataataatataacagagtcagtatatttaatataaaaaatcttactaaaatcaataagaaaagcactaagaccccaatttataaatggggcaaggggctgaatcactactaaacatataaaagcaggttaaccttatttatagccaaagaattataaaataaaatgacaaactttttttactctggcaactattgttataaattgtcataatgcttatgatggtatagtgaagtagcaacctcatacactgttgacagaaatataaattggttgagctttcctaggaagcagtttgtatatatactgaagaatctttcaaatacttaaagttatgctcttcaacagagtaattatagtcctggaaatttaatcagtaagatgggtaaatacttatat

SEQ ID NO: 60744 - DNA, 309 bp, Homo sapiens
ggcgatagtgtgagtccatctcaaattgaaaaaaaaaaaaagagagagagcgagaacaagaaaaatgcacatctgtcagggctcttcctattacatacagttaataccttattgaattttgtactgttattttagtatggctattagagcagtgatctgcagtgtttggcatgcctcaaatgtcagaaaaatccagagacacacctgtgagcatcaagataattttacttccattatttcaatctacagctaatgcttagtaatcacagtatttaaaaatcccctacaataagtctgcacaagtctgtg

SEQ ID NO: 60745 - DNA, 331 bp, Homo sapiens
gctcttgaacgggcagtgagcttgcatgatgctctgattattaagaagctgtaatgttttttccaacccagccatccttcgttattctaattactccttacatatacttttgtatatctctgcttctctcttctcaccctcccaccacattaattctgagcactatatcttaatactctaggtatgattaccccaaagaatcaagttaacttaccacctcccacattctaggcactatacattcattcatataaccatgttttgctgggattatctgggggatgcagaaggggctttataattagcaatgccccttactttgacttgccca

SEQ ID NO: 60746 - DNA, 321 bp, Homo sapiens
gcctcagaaggtccttcccaggcttctcgcaaagcgaaggcactgcctcttcacaccttgtgaaacctttccaggacctcccagtcagaggccgtctggttctcactgtctgcagagcgccctacagcctgtctgtgggtgagcgtgtctgtgaactcttgtccatctcttctgtgatctgtgtgctcctcgaaataactgattttgtctcatacaccttggaatcctgagtccacagaacagaggctcatacaaaggaagctttcaaagagtgctcatcgatttctaggtttcttgaagacaggcaccatgttttgttct

SEQ ID NO: 60747 - DNA, 227 bp, Homo sapiens
tatttttctaaaaaagaaagagtgaatggataaaatggagttttctaattcaggtgtttacttttgagagatagaaattaaatccgtagttcttgcaactttttttttttaaacccaaatcctttctacaattagtaattaaagtgaaatgagaaaagaaagagtagctttgaatctcactcagttgcttaatgctaaaataatctattaaaatttttttttctatg

SEQ ID NO: 60748 - DNA, 470 bp, Homo sapiens
gtgaggctctgtgaggccctgtgatgctccaagaccaggccccgcccactccggcctccaaccagccatggtctccaaaaaggatgggaaaaagaggttggggaaaagagagggccttgactttggctgcctgaagaactgtttttcttaaagtaggctttatatcagtctttttcctcggccacaggagggaagagggtggtgggagtgagtttagtctgactggggctgaagacatcctgttgtttaggactgcagttctccaacgttccagccccggtgcccatttgcttttgttcatgtggattatatctatcatacgtactgcattagagattaaaacagaattaaaaagacatattaattgggcaatttagtaagaataaacccatgacacaatagcaaatcttatttttatgtaaattttattaagacaaaatgtagtgagaagagtggcatcgttttacagt

SEQ ID NO: 60749 - DNA, 2784 bp, Homo sapiens
tctggcaaccatttctgtcagctttctcattcctagattgatgcagattgcttaattccttgagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgttcgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttt

SEQ ID NO: 60750 - DNA, 3532 bp, Homo sapiens
cctcaagcggcgctagctctctggctggcgctggagtgtgccgcccctggcagccccgccgctgcagcggggagcctgggagagcggctctcggagtctcaggcagcaggaggagcgtgtgagctgtgggcgtccctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgttcgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttt

SEQ ID NO: 60751 - DNA, 2968 bp, Homo sapiens
ctaggggcgagctgctaactcaggggcgagctgctaactcaggggcgagctgctaactcaggggcgagctgcaactcaggggcgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgttcgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttt

SEQ ID NO: 60752 - DNA, 3652 bp, Homo sapiens
cctcaagcggcgctagctctctggctggcgctggagtgtgccgcccctggcagccccgccgctgcagcggggagcctgggagagcggctctcggagtctcaggcagcaggaggagcgtgtgagctgtgggcgtccctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgttcgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgttaaccgttataaggagctttactcgcttcgggttttgttctctgttcg

SEQ ID NO: 60753 - DNA, 3393 bp, Homo sapiens
cctcaagcggcgctagctctctggctggcgctggagtgtgccgcccctggcagccccgccgctgcagcggggagcctgggagagcggctctcggagtctcaggcagcaggaggagcgtgtgagctgtgggcgtccctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgttcgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttagatactcttgatacttgctgcattccgggcacct

SEQ ID NO: 60754 - DNA, 3598 bp, Homo sapiens
cctcaagcggcgctagctctctggctggcgctggagtgtgccgcccctggcagccccgccgctgcagcggggagcctgggagagcggctctcggagtctcaggcagcaggaggagcgtgtgagctgtgggcgtccctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgttcgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttcccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgttaaccgttataaggagctttactcgcttcgggttttgttctctgttcg

SEQ ID NO: 60755 - DNA, 396 bp, Homo sapiens
aggcaaatgatttcaaaaacacagtcttgcatgtgctaaggaaaaaaacgacattgactgatcacatagcaatctatttgctcagtaagacccctctcacttacaagcatttgaagccaggaatgttgttctttatctcccagtgcaacccttctttatccctccgcagcagaagcatccagtaccccatctacctagatgatcctgagtcaacaaaaacccttctctttgaaaataagggtttttttgtttgtttgtttgtttgtttgtttgtttgttttttcttgtctgtttcattacaggagagttacaatgcaggagttaaacattatgaggctgatgactttgagatggctatcaggcatttcgaacaagccttaagagaatatttcgttg

SEQ ID NO: 60756 - DNA, 789 bp, Homo sapiens
atcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaccgtcatctgcttatattttgggggcccctcctcattgctgctatccagcacacagatttgtgcttgtgtctgatttgtttaataaagggaggcttattt

SEQ ID NO: 60757 - DNA, 165 bp, Homo sapiens
aaaaaaaaaaagccttggattcagtctacccattcgctaaagagagtttgatctccatgtgatcattttcaaagcaaactttaaccctgctctgatagaaaagaattaccagatgagtcttaaaacaaaaatttctggttgtttaatgaaagttgcattaataaa

SEQ ID NO: 60758 - DNA, 325 bp, Homo sapiens
tagctcagaggacatgaaatttatttccataaataaaaatgttatgtttcttcacattattcactttccccaaacagaaattcacacttcaaaaaattagcttttggttttagaattcagtcaattctgcatactcgactctaatattatgatttttaaaaatgtacatctacgacccagcaattccacacttaggaatattcccaagagaactgcgtatatgtgttcactggaagatatgcattagaatggctctagcagcattattcataatagctctaaattggaaattctccaattgcacatcaacagtggaacggataaa

SEQ ID NO: 60759 - DNA, 6203 bp, Homo sapiens
  misc_feature (6194)..(6194): n is a, c, g, or t
  misc_feature (6196)..(6201): n is a, c, g, or t
  misc_feature (6203)..(6203): n is a, c, g, or t
ggtttttaggcctggccgccatggcgtctccttctagaaactcccagagccgacgccggtgcaaggagccgctccgatacagctacaaccccgaccagttccacaacatggacctcaggggcggcccccacgatggcgtcaccattccccgctccaccagcgacactgacctggtcacctcggacagccgctccacgctcatggtcagcagctcctactattccatcgggcactctcaggacctggtcatccactgggacataaaggaggaagtggacgctggggactggattggcatgtacctcattgatgaggtcttgtccgaaaactttctggactataaaaaccgtggagtcaatggttctcatcggggccagatcatctggaagatcgatgccagctcgtactttgtggaacctgaaactaagatctgcttcaaatactaccatggagtgagtggggccctgcgagcaaccacccccagtgtcacggtcaaaaactcggcagctcctatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccataggggatagggtggtcagctacacacttggccgcaggcttccaacagatcatgtgagtggacagctgcaattccgatttgagatcacttcctccatccacccagcagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatcgtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtccaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaggggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgctgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacattttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtnannnnnnan

SEQ ID NO: 60760 - DNA, 2888 bp, Homo sapiens
  misc_feature (948)..(948): n is a, c, g, or t
  misc_feature (1862)..(1862): n is a, c, g, or t
  misc_feature (2367)..(2367): n is a, c, g, or t
aatcaatagttgcccagtgaaatcactgtcttcgttgcctgtagctgatttttaaaagcattggtgctgatgagaccgtccaaggacaaggaagtcggaggctgatcagcttctctctctcagatttccaagccatggggttgaagaaagggatgtttttcaacccagacccttatctgaagatttccattcagcctgggaaacacagcatcttccccgccctccctcaccatggacaggagaggagatccaagatcataggcaacaccgtgaaccccatctggcaggccgagcaattcagttttgtgtccttgcccactgacgtgctggaaattgaggtgaaggacaagtttgccaagagccgccccatcatcaagcgcttcttgggaaagctgtcgatgcccgttcaaagactcctggagagacacgccatagggtaaacctgtgactgagatcttactatcactaggttcccaccaacaggtcgtgcccaaaggtggcctgtaggctgcaatagtatagtctcacagagagtcaaaatggtatcattatatttcctttgtttttcctactaattatgttgcctgagccaacataagtgtttgttatattaaacaaacccatcccttttcacttgatgtgtaacactggttacttacccaagagagtaaaaaatcctattaaaaatattaaacagtattaaaagaagccctcaatggggcatttttctgtacaggtagaaactaaagtttgttttactatgaagaatattatttcattcatatgccagtctggtatgtaagatttaatcatatgtgacatttccataacaagatggaatactgggtaactactgtagagtttcttacttagaagacactagtatctgcagatgctagataacatggataagaatttgaaagcatgattctcatggaatgacagcanttaagatgctcacagaattcaattgtatatgagaatgggtttctgttttgtctcttttacattcatgtccactcatggttctcattaaagtggactatgaccagataacagccctatgtataatatgtatttctttaggtaacagggactacatttgaaaacactaaataaagctttctattgataaacatatacttatatacaatgtaacccttacaaagatagcaaaagaatgagaaaaaaatatgcagaatttccaagtgtcttaatttaaagttctttggattatcagaaggactttggaatcacggataattatcataaagacatttattattaattggaaccttatggtgtgtaggcagcagggtgcacagagacctgccactaactctccagccaaagggagctgagtttatggagctgcagtcacgtgtcacatgcagtgtttgcacttgccattcatggttgtgaggattaaacagacaaaaagtgtacataaagaacctagcacggccactggcacgtagtaggaacacaaaagaaaatggtattccttgtgatcttttttatttcatttagtcctcataatgcttctgtgacagcattatcaccattcctgcacgaggaaacaaggcttcaaaaggatcaataattatgtaaacccaaggcttgtgggtggcagagatccggccggaattcagactcacacctgtgtctctccaaagtccgagggccatccccacacaacaggcttctctcagggttcctaggactgattctgtagtttattgtgggccatgcttttcatttctctccttctctgccctactggctgctctcacagctgttagcacctctgccagggggtgggctggagaacaaaaacaggggctgtgtgggattctttctancccagcacccagtgcactgccgcccagcatgcattagatagataccagttcgtacgtaaggaacagaacttctctctccagctcgctgcagccgcagagcccctctgccctcccatgctgagttctctcctaagtccaagctgccggctcctatcttcttagcactgtcccgccctccaagcctcccactgtggaaaggcacatccccagctgaaagcaagtacctgaggtggaaaagggtgtccccgaccaaaagaaggttagctatgattttcccagtgttcttgccacccagggaaatggagagcacagatcgagtgtgattgagcttacacctctccaagaggcaacaacagcaagccatggaggcgtttttcctcccaccctctttgatgggatgatagactgccccctggtggcggcgcagagcagctcctcctccaaagccttctgcttccacagcccctgggggccacttctgcagtgctgcctcctccggaggtgncccaccgtggttaggagcagagtgttggggtgatggccatggaagcagtggccatgcagcctgagccatggcagaaccccagagtgcacccacaacaaaagtgaatccactttgcaccgcagcttccctctgccctcagcacatgctctccccataaagccccctgcatccgtggtttctgaaacgtttggctccacctgtactggctgcctccctgccctgagatatttgcacctttcccccctgggcacacatgcactctcatttccaatcctccttcgattccttggcctgtaaaatcccaggcttctgttggctgtctgcctgtaactctaaccatctcaccttcgcattgaagtgtcactggctgtcttgaaccattatttagtggtcctaccttatgcccccagctggacataagctatttaaaggcaggggcgatgtatgacatgctttgtatcaactgcagcacctttcacatggcaggggctcaaaaaatatttgttaagtgggtgaaaagc

SEQ ID NO: 60761 - DNA, 5270 bp, Homo sapiens
  misc_feature (5261)..(5261): n is a, c, g, or t
  misc_feature (5263)..(5268): n is a, c, g, or t
  misc_feature (5270)..(5270): n is a, c, g, or t
gtccagaagccagtgatctattctggaagccaggttgctgtccccctgatagagaagctcctcttcattcagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatcgtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtccaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaggggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgctgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacattttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtnannnnnnan

SEQ ID NO: 60762 - DNA, 5216 bp, Homo sapiens
  misc_feature (5207)..(5207): n is a, c, g, or t
  misc_feature (5209)..(5214): n is a, c, g, or t
  misc_feature (5216)..(5216): n is a, c, g, or t
gtccagaagccagtgatctattctggaagccaggttgctgtccccctgatagagaagctcctcttcattcagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatcgtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtccaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaggggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgctgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacattttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtnannnnnnan

SEQ ID NO: 60763 - DNA, 3844 bp, Homo sapiens
  misc_feature (3835)..(3835): n is a, c, g, or t
  misc_feature (3837)..(3842): n is a, c, g, or t
  misc_feature (3844)..(3844): n is a, c, g, or t
ttggacgaggaatccaccagacgtttgcagtggataaggacaacaacatcacagacatcttagacctcactttcactgttaatgaagaggttttcggacagactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaggggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggcctcagaagtttctagaaacagaggagcctctttactggccaggccaggacacagcttagtagctgctattcgaagccaacatcaacatgagtcattgccactggcatataatgacaagattgtggcatttcttcgccagccaaacatttttgaaatgctgcaagagcgtcagccaagcttagcaagaaaccacacactcagggagaaaatccattacattcggactgagggtaatcacgggcttgagaagttgtcctgtgatgcggatctggtcattttgctgagtctctttgaagaagagattatgtcctacgtccccctgcaggctgccttccaccctgggtatagcttctctccccgctgttcaccctgttcttcacctcagaactccccaggtttacagagagccagtgcaagagccccttccccctaccgaagagactttgaggccaagctccgcaatttctacagaaaactggaagccaaaggatttggtcagggtccggggaaaattaagctcattattcgccgggatcatttgttggagggaaccttcaatcaggtgatggcctattcgcggaaagagctccagcgaaacaagctctacgtcacctttgttggagaggagggcctggactacagtggcccctcgcgggagttcttcttccttctgtctcaggagctcttcaacccttactatggactctttgagtactcggcaaatgatacttacacggtgcagatcagccccatgtccgcatttgtagaaaaccatcttgagtggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacattttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtnannnnnnan

SEQ ID NO: 60764 - DNA, 4583 bp, Homo sapiens
  misc_feature (4574)..(4574): n is a, c, g, or t
  misc_feature (4576)..(4581): n is a, c, g, or t
  misc_feature (4583)..(4583): n is a, c, g, or t
gtccagaagccagtgatctattctggaagccaggttgctgtccccctgatagagaagctcctcttcattcagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatcgtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtccaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaggggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggctagagtgcaatggtgcgatcttggctcactgcaacctcctcctcccaggttcaagcaattctcctgcctcagcctctcaagtagctgggattacaggttcaggtttagcggtcgcatcctgggtctggctctgatccatcagtaccttcttgacgctttcttcacgaggcccttctacaaggcactcctgagactgccctgtgatttgagtgacctggaatatttggatgaggaattccaccagagtttgcagtggatgaaggacaacaacatcacagacatcttagacctcactttcactgttaatgaagaggtttttggacaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacattttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtnannnnnnan

SEQ ID NO: 60765 - DNA, 2687 bp, Homo sapiens
  misc_feature (2678)..(2678): n is a, c, g, or t
  misc_feature (2680)..(2685): n is a, c, g, or t
  misc_feature (2687)..(2687): n is a, c, g, or t
tgccagaggatccctggctatcatcggcacccagctgtgggagtggaagctgatggctgttaagaatttgctgtcattgagatttgggggcatcaagtatgtgattgtagtgttgagacattcagcttcaccattagggacaacctaggacattttccttttatttccattatgcctcttgagtataggaaacttgtttcctctgtataaaacaaaaactgtagcctttccaaggtgcttagcaatctgcttagaggtcgggtgcagtggctcccaatactttggagttgggaggatcagttaaggccaggagttcaagactagcctgggcaacatagaccacattctaccaaaaaaaaaagaagaagaagaagaaagaaaaaaaattaaccaggcggagtggggctggtcggtggtcccagctactcaggaggctgaggcaggagggtcattggcccccaggaatgcagggctgcaataagctatgattgcaccactgtgctccaatctgcttagaacagccagagctcttttagtgacctttagcaaggaaaaaagactccagggataataatgctgaataatgccctgtagaggatttttggcatacggtcatccccctaaaatcagtgtgcctccctgagagataagcagaactgacaagcatcgcaatatttctgttttcctacaaggtcacggaaagggagttgaagtctggaggagccaacacacaggtgacggagaaaaacaagaaggagtacatcgagcgcatggtgaagtggcgggtggagcgcggcgtggtacagcagaccgaggcgctggtgcgcggcttctacgaggttgtagactcgaggctggtgtccgtgtttgatgccagggagctggagctggtgatagctggcaccgcggaaatcgacctaaatgactggcggaataacactgagtaccggggaggttaccacgatgggcatcttgtgatccgctggttctgggctgcggtggagcgcttcaataatgagcagaggctgagattactgcagtttgtcacgggaacatccagcgtgccctacgaaggcttcgcagccctccgtgggagcaatgggcttcggcgcttctgcatagagaaatgggggaaaattacttctctccccagggcacacacatgcttcaaccgactggatcttccaccgtatccctcgtactccatgttgtatgaaaagctgttaacagcagtagaggaaaccagcacctttggacttgagtgaggacatggaacctcgcctgacattttcctggccagtgacatcacccttcctgggatgatccccttttccctttcccttaatcaactctcctttgattttggtattccatgatttttattttcaaaccaaatcaggattgacaaaagctgtgcatgaagaactgccttcttctaagatctaaccttcaggcttctctcctctgttttcaatgaactgctagcctgtatgcaatattaaaaaacagctgtctcaaggtctgtgtatatctccacatacctccattactaacaatgaaatatgaatgcaagttaagctacacttgaccaaatggtaataaatgtttacttccatttctatcattgaagggaaaatgtgagcattaagcactccaggctttcatatgcccatgtcttctgagcagagccaccattttttataatttctaataaccaactccagaactaggagctgatcaactctttgttttcctctccatctacttttccctgtgcataatatccatccaaaggacaacagtggcaaagctgaaatttttatacattcaactcatgattcacatgtggcatcagtcccatcagccggaactagcctagacatacggtgcaaatatgacacttctaacgattaacaacagcaagaaaacacctgctgctgatgcaatgcaatgcatcccaatggttgtggggattgtgggctcaactcaagagaagtttaggagggggagcatccctagtgaatactcacaccacaagaaggacaaacttgtgcacatgtccaagaaagaaagcttcttgattgaggtagcatgaaggatgaggcttcagcccccattgtcttatgtagaatgtggcaatgccaactggagaaagggaagaaggacatattaccttggtttgaatccctgagttctgtactgttctgttttgtttagtctagccacagttcttcacaaaggaaaaaaaaatgtgtagatgataccatgacttttgttaaagccatgacttttgtttgcttggcagacaaaccctttttttaaaactttgatatttttttttcacattttttttccttttcctttcttaatcatggagttcaagttcctttgcattcgattgtccatcgggaccacactaggaagctgcagagagtgatggtgcttgttagggatcaagggcaacatagtacttctccttcacccatagtaatcctcctggggcagaaacataacaccccaaaggcacgttgatttgtatcaaaataaatatccagtttcttttagcattcagtgaaaacatatctcagaaaacttcatgttgtcagaaaaacagctgcaggctccaaagacagcctaacctctcaactacatttgaaataaacccaaccataatggtnannnnnnan

SEQ ID NO: 60766 - DNA, 2618 bp, Homo sapiens
gtccagaagccagtgatctattctggaagccaggttgctgtccccctgatagagaagctcctcttcattcagatgatgaggagatttccctgagtaccgagcctgagtcagcccaaattcaggacagccccatgaacaacctgatggaaagcggcagtggggaacctcggtctgaggcaccagagtcctctgagagctggaagccagagcagctgggtgagggcagtgtccccgatcgtccagggaaccaaagcatagagctttccagaccagctgaggaagcagcagtcatcacggaggcaggagaccagggcatggtctctgtgggacctgaaggggctggggagctcctggcccaggtgcaaaaggacatccagcctgcccccagtgcagaagagctggccgagcagctggacctgggtgaggaggcatcagcactgctgctggaagacggtgaagccccagccagcaccaaggaggagcccttggaggaggaagcaacgacccagagccgggctggaagggaagaagaggagaaggagcaggaggaggagggagatgtgtccaccctggagcagggagagggcaggctgcagctgcgggcctcggtgaagagaaaaagcaggccctgctccttgcctgtgtccgagctggagacggtgatcgcgtcagcctgcggggaccccgagaccccgcggacacactacatccgcatccacaccctgctgcacagcatgccctccgcccagggcggcagcgcggcagaggaggaggacggcgcggaggaggagtccaccctcaaggactcctcggagaaggatgggctcagcgaggtggacacggtggccgctgacccgtctgccctggaagaggacagagaagagcccgagggggctactccaggcacggcgcaccctggccactccgggggccacttccccagcctggccaatggcgcggcccaggatggcgacacgcaccccagcaccgggagcgagagcgactccagccccaggcaaggcggggaccacagttgcgagggctgtgacgcgtcctgctgcagcccctcgtgctacagctcctcgtgctacagcacgtcctgctacagcagctcgtgctacagcgcctcgtgctacagcccctcctgctacaacggcaacaggttcgccagccacacgcgcttctcctccgtggacagcgccaagatctccgagagcacggtcttctcctcgcaagacgacgaggaggaggagaacagcgcgttcgagtcggtacccgactccatgcagagccctgagctggacccggagtccacgaacggcgctgggccgtggcaagacgagctggccgcccctagcgggcacgtggaaagaagcccggaaggtctggaatcccccgtggcaggtccaagcaatcggagagaaggtgaatgtcctatactccataattcccagccagtaagccagcttccttccctgaggcctgaacatcatcactacccaacaatcgatgagcctcttccaccaaactgggaagctcgaattgacagccacgggcgggtcttttatgtggaccacgtgaaccgcacaaccacctggcagcgtccgacggcagcagccaccccggatggcatgcggagatcggggtccatccagcagatggagcaactcaacaggcggtatcaaaacattcagcgaaccattgcaacagagaggtccgaagaagattctggcagccaaagctgcgagcaagccccagcaggaggaggcggaggtggagggagtgactcagaagccgaatcttcccagtccagcttagatctaaggagagaggggtcactttctccagtgaactcacaaaaaatcaccttgctgctgcagtccccagcggtcaagttcatcaccaaccccgagttcttcactgtgctacatgccaattatagtgcctaccgagtcttcaccagtagcacctgcttaaagcacatgattctgaaagtccgacgggatgctcgcaattttgaacgctaccagcacaaccgggacttggtgaatttcatcaacatgttcgcagacactcggctggaactgccccggggctgggagatcaaaacggaccagcagggaaagtcttttttcgtggaccacaacagtcgagctaccactttcattgacccccgaatccctcttcagaacggtcgtcttcccaatcatctaactcaccgacagcacctccagaggctccgaagttacagcgctggagaggtaaccctccctacaccccgccctactgttcaccggtcacagtctctgcctcttccatgggagcagaacagttcttcagtggctaggatctagggttgcctgcgctggaagagattaagccatatgcaccctgctttgtagaagaatgatgaccgggacacccacttaacaccccagagctgtcttcagttaccttttctgccttgccttttgtcccacacaatcaccactactaaaaacctgtctagttgaaaggaaactgaaaatgcactgtcaggagatccctacacttatggctggagctgtgcctcctgaggcctgtcatgtgtgaatacatggaactgccatggtatgtct

SEQ ID NO: 60767 - DNA, 519 bp, Homo sapiens
gctttttttcactggtctgttcgcagtcttttttcgtggaccacaacagtcgagctaccactttcattgacccccgaatccctcttcagaacggtcgtcttcccaatcatctaactcaccgacagcacctccagaggctccgaagttacagcgctggagaggtaaccctccctacaccccgccctactgttcaccggtcacagtctctgcctcttccatgggagcagaacagttcttcagtggctaggatctagggttgcctgcgctggaagagattaagccatatgcaccctgctttgtagaagaatgatgaccgggacacccacttaacaccccagagctgtcttcagttaccttttctgccttgccttttgtcccacacaatcaccactactaaaaacctgtctagttgaaaggaaactgaaaatgcactgtcaggagatccctacacttatggctggagctgtgcctcctgaggcctgtcatgtgtgaatacatggaactgccatggtatgtctg

SEQ ID NO: 60768 - DNA, 348 bp, Homo sapiens
ccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtga

SEQ ID NO: 60769 - DNA, 961 bp, Homo sapiens
gcctggcaataggacttagtgtacagacccctggattaggatagcatctgcatatagtaggtacaaaggaataattttttcccccagaaataactggaaactctataattgttatgttgattattgtgtttaaatctaattaaggtattttgttttcctttttacataagaacataactttctgcaataaaatactagcttatatcagttagacttaatttactctgtgcccttaccctaggtagacacttgaattagctttcatatactcatttcagagtttttttaaaaatgatttattattattattttaaatagagacagggtctccctatgttgcccatgctggttttgaactcctgggctcaagtgatcctcctgccttgtcctcccaaaatattgggattataggtgtgagccaccacacccaacctcatttcagagttttaagggaatttcagagtttctttattttacatatgaaatccctgaggctcatgagtaaaatgatttataggaatctgaatccaggctttatgatttgtactcatgtcagtaactcatatgaggaataaaactaaacatttaatttaatgtgtatttgttcattttatttattttactctttctgattcttatgtaatcattaacttgctcattttaattgctagattttacttaaacaatttcagctagaaatatatttcatttggaagattaggctgtggtggtatgatatttttccatttctgatgagactgtttttatcccacacatttaagtgataggttgtttttaatgttttaaaacagaaaaggattagagtattttacttgggctagtaagaatgaaaataaatcagctcaaagagtcagaatagtaaatatactataatctgaagagaaaaaagtcagaatgcaaaaagcacaaaagtagctgtccctctgccccaagaaaaaga

SEQ ID NO: 60770 - DNA, 568 bp, Homo sapiens
cacaacaccctaggctcactgaatattctattactcactcttactgcccaagaactatcaaactcctgagccaataacttaatatggctagcgtacacaatagcttttatagtaaaaatacctctttacggtctccacctatggctccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctgtgaggcataattataacaagctccatctgcctgcgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaaccctactcccactaatagcct

SEQ ID NO: 60771 - DNA, 431 bp, Homo sapiens
aaccagaatgggagaagagctagttatgagctcttgaactttcatggtgaggacaccatttcctctgcccttgggcttaagtgacagtttacaaaccagattttttatctatgactctttcatgaccatatgacgatcatttcaagctcaggaagtttcctaagcctcagtgatctaaggagtgccattgatttgtgatgtggagactttgctcattcacctccttggtccaattcatacatttaagcatcagctcgtccctgagcggagatgctttctccagctccttgcagccatgtggcagagggtgactcccagtactgcttcctgatctacagatccccatggatgtccctggcttctttagaaattttctttacaagaggccacagtggaagatagtggtaagacttacttagacctacagcatc

SEQ ID NO: 60772 - DNA, 95 bp, Homo sapiens
  misc_feature (20)..(20): n is a, c, g, or t
  misc_feature (29)..(29): n is a, c, g, or t
gtgagggctgtggttggggntcagcttcnttcttaaatcgttccttgaacctttaccctattctgtgcactgtgccgatttccagggattggaag

SEQ ID NO: 60773 - DNA, 214 bp, Homo sapiens
taaccccgctccctacccctgaaccatcacaactatcatgtcacatgcacgggtttcttttcaccattgcatttgtcttatttgatttctgtgtttatgtatttgttgtccatcctccaagtgacagagggagtggatggagtgaaggataagttttgtcctgttcactgcccagcatcaagaaaagtgcttggaactgagtagatagtcaaca

SEQ ID NO: 60774 - DNA, 484 bp, Homo sapiens
  misc_feature (13)..(13): n is a, c, g, or t
  misc_feature (30)..(30): n is a, c, g, or t
gctgcgctcggtnaactcggcgagcccttnaggtcatcttctgcaatcgcagtccgcgcgtcgtgctgcccgtatggctcaacttcgacggcgagcccaggcagccctacccaacgctgccgcctggcacgggccgccgcatccacagctaccgaggtacgggcccggcgcttaggcccgacccagcagggacgatagcacggtctgaagcccctctaccgccccggggtccattttgcagacggggaactgaggccccttgaggcaggacacatccagggtgacgctgctcgtaagcgacagagcgagactgcatctcaaaaaaaaaaaaaagaaaaagaaaagaaaattctggtataatttacatacagtaaaatgcacagatcttagggtttgatgagttttctctcgacatgtttttgcactccagcctgcgcagcaggagtgaaattccatctcataaagataccaaaaaaacaaaaaa

SEQ ID NO: 60775 - DNA, 584 bp, Homo sapiens
  misc_feature (13)..(13): n is a, c, g, or t
  misc_feature (30)..(30): n is a, c, g, or t
gctgcgctcggtnaactcggcgagcccttnaggtcatcttctgcaatcgcagtccgcgcgtcgtgctgcccgtatggctcaacttcgacggcgagcccaggcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacagggagactggacatcgtcaggtcgctctacgaagatctggaagaccacccaaatgtgcagaaagacctgggagcggctgacacaggagcgcattgcacatcaacggatggggagattgaagatttctgttgaaactttacactgtttcatctcagcttttgatggtactgatgagtcttgatctagatacaggactggttccttccttagtttcaaagtgtctcattctcagagtaaaatag

SEQ ID NO: 60776 - DNA, 461 bp, Homo sapiens
  misc_feature (13)..(13): n is a, c, g, or t
  misc_feature (30)..(30): n is a, c, g, or t
gctgcgctcggtnaactcggcgagcccttnaggtcatcttctgcaatcgcagtccgcgcgtcgtgctgcccgtatggctcaacttcgacggcgagcccaggcagccctacccaacgctgccgcctggcacgggccgccgcatccacagctaccgagtgtatactctgaaagagcgatgcctccaggttgtccggagcctagtcaagcctgagaattacagggagactggacatcgtcaggtcgctctacgaagatctggaagaccacccaaatgtgcagaaagacctgggagcggctgacacaggagcgcattgcacatcaacggatggggagattgaagatttctgttgaaactttacactgtttcatctcagcttttgatggtactgatgagtcttgatctagatacaggactggttccttccttagtttcaaagtgtctcattctcagagtaaaatag

SEQ ID NO: 60777 - DNA, 1249 bp, Homo sapiens
cgtgtgtctacacacattcaagaatagtcacctacttctatatctatttatatacatacgtattgaaaactttgagttcacattgacaccttcaattcaatcctttgaggttaatctagtctccctttccatctttgtaacttccttctctcatagaaacctgactcccataatcctaaataatttgttcattcttcctccctccctcaacctcttgacatgccagctgctgtctcatcacacccagtcccaaatatgccaaataaatccgcagtcatagcagcgctggtcctgaccacaccaatccctaacatcctccccagcctggagcctggaccatggcagctgaatctttgaccccagtgatgtcagtcctgagcacaccattggaatcctaggctcctgtcatctggctggaagagagacaaattcacaaccttttgataatgagcaattattgaatactcactgaatttatcagagaaagtttaaaagtgtacgattatacatatttaccaggaatgtttaaacatagacatttatgaaatttatagaaaatattgaattgtggttctcactttttggtcttggctgtaacaatttttaaatattaatacttcctacaataactgtatcatgctatttttaagtgtcctcacactcaaccaatctactctgcatccataaaataagcatgcagttcagaaaatagattaaacgactaattggctatgcttctgagttacaagttttatttgagttcatcttcagctttaaacaattaacaaaaagctgtacatgacatgaaaacctgtctcagatttctggatgcagtcatgcccattcgttacaggatattgtaagtcttccttttatagtgttgacagtactggaaatgagatgaatagtgaccgttaccaatgaggcattgctcattgataagtgaatacagcactgaaatttaaaaatcaggccgggcatagtggttcatgcctgtaatcccagcactttgggaggtcaaggcgggtggatcacgaggtcaggagttcaagaccagcctgaccaacatggtgaaaccccgtctctactaaatatacaaaaattagccaggcgtagtagtgtgtgcctgtaatcccagctattcaggaggctgaggcaggagaattgcttgaacttgggaggcagaggttgcagtgagccgagatcacaccactgcactccagcctgggtgacagagtgagactctgtc

SEQ ID NO: 60778 - DNA, 436 bp, Homo sapiens
actaaagaaaaatatgcttatttccccaattttctagttatgggtactcaatggtggttatcccgtatctgcaatttgctatcttgtagttagaagtcaagccaatcccaagacacaagagtagaatgttgtaaattttttggacctcagagattcttgtaatattggaagattcttttttttccatcttaatgccatttcagtagtatattgctatcatatatgtatatatgattagaatcagggacagcagtgtaagttggagtaacttttaaagggagaaaggactgggttaataattatatctaaagaatttagagaagcaaagaaggaccatttattagatattcagcaatactcgttaccttactaaagatataagtggaaaatcccttaggtatgagctgagaggagtgttaaaaaaaaaaaagaaaga

SEQ ID NO: 60779 - DNA, 428 bp, Homo sapiens
aaaaaaatcctgtaaaaaagattgtatatggaaaagcatgtgcattaaaaagaaaaatggaggcatgtccagtcttccctctgcctggattattctcaaccatcccccagctgccccacaacacagtcacaagcggaatctctacccatttttccaaagttaattcaaattttttcccttatattacattatataaagcttttctagaaattctacaccagacaaagctactctgtatctctacctccatcacagcatttacattctatattgaaattatttcttggtatgtttgccttcatgaagctaattaagacttcatgagtcttaattagctctgtagactgatcatctaccatagtgtttggcattcaacagatgctcaattaacatttttgagtgatagattgatttcacacctttacttt

SEQ ID NO: 60780 - DNA, 415 bp, Homo sapiens
taactcattaatgttttttagtctcttaaataacattaaaattgtctcagagtctctagtatatttaacaattatataaagaaaaaaaaagagttgttcatcctgccattcagtaaatacctgctgacaccttattggccaaatgtgccagatgcagggatgtgaaatataccccatgtctgctttcacaaagcttccaaagtagtgataaagagaaagagagtgaaagacatgggaaaacatatctttgtgttttatttgatgattatcattctgtgtctattatttgtttgaatattagtttacccccatttctttaactggagtgagaggaatggactatatcttcttattctttttatcttcttgggacctaggagaatgccttaataaatacgtgtggaatccactgcaa

SEQ ID NO: 60781 - DNA, 146 bp, Homo sapiens
aaaaaactgaaacaaaataggaggcaataaacaaaaataatatcacacataaataagaaacaaaacaaagcaagaaacattgtagagttatttagtaagaccactaggtagtttatgggaagattcatatattagttgagtcttag

SEQ ID NO: 60782 - DNA, 367 bp, Homo sapiens
tgtcattggtttattgggatggttttccattgtatccagcactgatgggctcttttcttatttctggaagtctgtgtgccaccgttgtatttttttgtgcgtcagaacgtcaacttcataagcttaaaatactcgtcagagagccatatagaagtgtgtaattgaacacaaaatcatagaataagtttgacctggaaaccataaaactccttcctagtgacattttacagctggtccatttaaagagacatccttcattcccaataaattattctgccctaaaaataatgcttatgctttggtaaggtgctgttagctaccttacagccctcattgtctactagttgggacaaagaacgaaaaagta

SEQ ID NO: 60783 - DNA, 380 bp, Homo sapiens
ggtagaggttgcagtaagccgagatcacgccactgcactccatcctgggcgacagagcaagactccatcccccccaaaaaaacaaaacctggacagagtggccccctgcaggccccccgcttcttggggctggagcaagtgttcttatagatgtctctggtcgtcttggccactggctcggagacagccaccgagacccggcatttggagcagctggctgggatgctgcagggaggggtgtccaagcaggaggcagccaagcctgcctggagcaggataagatgagctcccctctgagactcagtattttctgttcaatgaaaggaacagtccagtatttgagacaggagaaccggaattgacttgactggtctgtggtg

SEQ ID NO: 60784 - DNA, 376 bp, Homo sapiens
ttacagcttcatagtactataaaacagattatcaataaattgcttattaacttatgggtagaaatttagatagttgtttgtgttttctgattctagaccatcccaccatgagcaagtctatgtatctgttgtgcctgtgtgagtttctctataaagcatagatctcaaaagatggaattatagtgtaaaattttaaatttggttagaaattgactaattgccttccaaaaatatttaagaatatgtaagactacctgttttccatagagttatcatagctgaacagaaccaatcataaagcttttacaaatttgttggtaaaataagtgacttcattgtctgaatttataatccatgattattggtgaagctgggc

SEQ ID NO: 60785 - DNA, 586 bp, Homo sapiens
  misc_feature (399)..(399): n is a, c, g, or t
  misc_feature (526)..(526): n is a, c, g, or t
  misc_feature (554)..(554): n is a, c, g, or t
  misc_feature (561)..(561): n is a, c, g, or t
  misc_feature (586)..(586): n is a, c, g, or t
gccatggatgaaggctcagaagcatcctcctgctcatctgctttggctaccttccagcataactaggaacattattagatttagtaatacataatttaaattctaaagtttaccattgttttgtctttttatggttatgggtgactatgtcatgaccaattgtcatttcataatctagagatttctttaaaacatgactatttctgttggatgtacatgtgtaagataggaaaactgccatttacatccattgtgtgcattatttgccctcatctccccaaacagaccaaaacaaaaaaccccaagaaatggatttgtcttatctttgtagtttatataccatggtataatgtaattttcaaattcatagcgtaacttacttgtttccataagcaaagntgtatgtaaactgtgtatcagtgcttctagtaatcttgctattgtcttggtactgaaattttagaccaatataatttgccaggaatcctttgtatgctaaacataactacataaaaatatgaaaaanattggtaacaatatattaccattacatngtttcanaacaattcaaataaattcaaagtcn

SEQ ID NO: 60786 - DNA, 519 bp, Homo sapiens
  misc_feature (39)..(39): n is a, c, g, or t
  misc_feature (43)..(43): n is a, c, g, or t
  misc_feature (47)..(47): n is a, c, g, or t
  misc_feature (51)..(52): n is a, c, g, or t
  misc_feature (59)..(59): n is a, c, g, or t
  misc_feature (63)..(63): n is a, c, g, or t
  misc_feature (478)..(478): n is a, c, g, or t
  misc_feature (480)..(480): n is a, c, g, or t
  misc_feature (483)..(483): n is a, c, g, or t
  misc_feature (498)..(498): n is a, c, g, or t
aacctccattctgctggaattatcaccagagatttaaanccangtancatnntagtcangtcngattgcacattgaaaatcctggactttggactggccaggacagcaggcacaagcttcatgatgactccatatgtggtgacacgttattacagagcccctgaggtcatcctggggatgggctacaaggagaacggagagtaaagatagaagcaaaaagttggaacttttaaacttgaaccctaagcaaaaatagtaaaatgtcttgacaaatcagagaatcttatgaaattgtcattgatgactgaagtttaactactttcccacattcaaactatctttgcattttgagaaacatcgtgggggtttcttggtggttgatatgatctagatgatatcacagggaattgtcttggttactgaattagaatgttggcaaaataaaattgaacaaaataaacaaggatgcggctcggcncntcnttttctttcacacancacggacgcatctcccccacg

SEQ ID NO: 60787 - DNA, 861 bp, Homo sapiens
  misc_feature (39)..(39): n is a, c, g, or t
  misc_feature (43)..(43): n is a, c, g, or t
  misc_feature (47)..(47): n is a, c, g, or t
  misc_feature (51)..(52): n is a, c, g, or t
  misc_feature (59)..(59): n is a, c, g, or t
  misc_feature (63)..(63): n is a, c, g, or t
  misc_feature (820)..(820): n is a, c, g, or t
  misc_feature (822)..(822): n is a, c, g, or t
  misc_feature (825)..(825): n is a, c, g, or t
  misc_feature (840)..(840): n is a, c, g, or t
aacctccattctgctggaattatcaccagagatttaaanccangtancatnntagtcangtcngattgcacattgaaaatcctggactttggactggccaggacagcaggcacaagcttcatgatgactccatatgtggtgacacgttattacagagcccctgaggtcatcctggggatgggctacaaggagaacggagagtaaagatagaagcaaaaagttgggacttcctaccaacaactgagcagtcagataacctctcaaactatgactatcagacacaaggctgagggctgattcaagttatttatcggcagaagaattacacaattttaagcatattgaaattagtctaacatttattggaagaaatatcaaagctaagtatatgctaattgataccttgactacttccaggactctgcagaaatttcaaaaaacaatcagaggttctcatgtctttcacctagaattattcagagtaatttatattaaattactttgaggctgaaaaatgatgtgataatactatcataataatcaacatttttcttctctcttcacagaacttttaaacttgaaccctaagcaaaaatagtaaaatgtcttgacaaatcagagaatcttatgaaattgtcattgatgactgaagtttaactactttcccacattcaaactatctttgcattttgagaaacatcgtgggggtttcttggtggttgatatgatctagatgatatcacagggaattgtcttggttactgaattagaatgttggcaaaataaaattgaacaaaataaacaaggatgcggctcggcncntcnttttctttcacacancacggacgcatctcccccacg

SEQ ID NO: 60788 - DNA, 150 bp, Homo sapiens
acagggaattgtcttggttactgaattagaatgttggcaaaataaaattgaacaaaataaacaatacatatttgcttttccacttattaatttgctaattactttaatatccagaggatcacttcttaatacttatttttcttgtgtaaa

SEQ ID NO: 60789 - DNA, 714 bp, Homo sapiens
atatattttatgaatttatactttttcctgagatttcaggagggaaaaatgagtaggagatgactgagagcttaaagtttgggagtgtcaattaactcagcattcttttaaaaaacatgtgtcatatattacagcatattcttttatttgaagtgagtaaatgtatctttttaaattccttagtaatttttgagcactccatatgtataaagcatgtgaatatttggtagcattttacaaatgtccagagatttgtgagagttcctgagatcttcatagggggcccacaaagtttagtattacttttcacggtaatactaaagtgtattttgcctctttttactttttctcttaatagcatacagtggtaactgaaggctaatagtatgtgtgtttatgtgctttaaaaagttcgtggttttggccaggcgcagtggctcagacctgtaatcccagcactttgggaggctgaggcaggtggatcacctgaggtcaggagttcaagaccaaaaccagcctggccaacatggtgaaaccccatctctactaaaaatacaaaaattagccaggcatggtagtgggtgcctgtagtctcagctactcgagatgctgaggcaggagaatcacttgaagctgggaggtggaggttgcagtgagccaaaatctcgccattacactccagcctgggggacaagagcaagactccatctcaaa

SEQ ID NO: 60790 - DNA, 362 bp, Homo sapiens
atatcattattacatggtatggttgatgtacgttttggcccaaatttctgtggaaacatgacttaccaaatgactttaccactgtgcccatttgtgtagcacagatggggatgcaaatagcagtatgagagagcgagttaccatcgtgcatctgcctttagtgaccatggaacatcacataaacaaacacataggcagcaaccagtctacattttaaataaaatatctttgccttttaaaaaataaataaccttttatttgttggtagattttagttacatttaataataatataaacacagaaagcctaggagaccaatgaattttataagcacaactatcatctttggggcaatggtttg

SEQ ID NO: 60791 - DNA, 120 bp, Homo sapiens
actgggggctccctggaggggcagggggcctgtcctatcctgttcacatcagcatccccacacagacccaatgcaagagctgatgcttttaagaagtgtttgcagaaggaagaaatgaag

SEQ ID NO: 60792 - DNA, 5389 bp, Homo sapiens
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctg

SEQ ID NO: 60793 - DNA, 5486 bp, Homo sapiens
  misc_feature (5414)..(5414): n is a, c, g, or t
  misc_feature (5417)..(5417): n is a, c, g, or t
  misc_feature (5423)..(5423): n is a, c, g, or t
  misc_feature (5443)..(5445): n is a, c, g, or t
  misc_feature (5448)..(5448): n is a, c, g, or t
  misc_feature (5450)..(5450): n is a, c, g, or t
  misc_feature (5454)..(5454): n is a, c, g, or t
  misc_feature (5465)..(5465): n is a, c, g, or t
  misc_feature (5469)..(5469): n is a, c, g, or t
  misc_feature (5471)..(5472): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60794 - DNA, 5405 bp, Homo sapiens
  misc_feature (5333)..(5333): n is a, c, g, or t
  misc_feature (5336)..(5336): n is a, c, g, or t
  misc_feature (5342)..(5342): n is a, c, g, or t
  misc_feature (5362)..(5364): n is a, c, g, or t
  misc_feature (5367)..(5367): n is a, c, g, or t
  misc_feature (5369)..(5369): n is a, c, g, or t
  misc_feature (5373)..(5373): n is a, c, g, or t
  misc_feature (5384)..(5384): n is a, c, g, or t
  misc_feature (5388)..(5388): n is a, c, g, or t
  misc_feature (5390)..(5391): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60795 - DNA, 5187 bp, Homo sapiens
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaaaaacctgtgtatgcttatgcctgggcaactattttttgtaactcttgtgtagattgtctctaaacaatgtgtgatctttattttgaaaaatacagaactttggaatctg

SEQ ID NO: 60796 - DNA, 5048 bp, Homo sapiens
  misc_feature (4976)..(4976): n is a, c, g, or t
  misc_feature (4979)..(4979): n is a, c, g, or t
  misc_feature (4985)..(4985): n is a, c, g, or t
  misc_feature (5005)..(5007): n is a, c, g, or t
  misc_feature (5010)..(5010): n is a, c, g, or t
  misc_feature (5012)..(5012): n is a, c, g, or t
  misc_feature (5016)..(5016): n is a, c, g, or t
  misc_feature (5027)..(5027): n is a, c, g, or t
  misc_feature (5031)..(5031): n is a, c, g, or t
  misc_feature (5033)..(5034): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60797 - DNA, 5198 bp, Homo sapiens
  misc_feature (5126)..(5126): n is a, c, g, or t
  misc_feature (5129)..(5129): n is a, c, g, or t
  misc_feature (5135)..(5135): n is a, c, g, or t
  misc_feature (5155)..(5157): n is a, c, g, or t
  misc_feature (5160)..(5160): n is a, c, g, or t
  misc_feature (5162)..(5162): n is a, c, g, or t
  misc_feature (5166)..(5166): n is a, c, g, or t
  misc_feature (5177)..(5177): n is a, c, g, or t
  misc_feature (5181)..(5181): n is a, c, g, or t
  misc_feature (5183)..(5184): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60798 - DNA, 5307 bp, Homo sapiens
  misc_feature (5235)..(5235): n is a, c, g, or t
  misc_feature (5238)..(5238): n is a, c, g, or t
  misc_feature (5244)..(5244): n is a, c, g, or t
  misc_feature (5264)..(5266): n is a, c, g, or t
  misc_feature (5269)..(5269): n is a, c, g, or t
  misc_feature (5271)..(5271): n is a, c, g, or t
  misc_feature (5275)..(5275): n is a, c, g, or t
  misc_feature (5286)..(5286): n is a, c, g, or t
  misc_feature (5290)..(5290): n is a, c, g, or t
  misc_feature (5292)..(5293): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60799 - DNA, 3891 bp, Homo sapiens
  misc_feature (3819)..(3819): n is a, c, g, or t
  misc_feature (3822)..(3822): n is a, c, g, or t
  misc_feature (3828)..(3828): n is a, c, g, or t
  misc_feature (3848)..(3850): n is a, c, g, or t
  misc_feature (3853)..(3853): n is a, c, g, or t
  misc_feature (3855)..(3855): n is a, c, g, or t
  misc_feature (3859)..(3859): n is a, c, g, or t
  misc_feature (3870)..(3870): n is a, c, g, or t
  misc_feature (3874)..(3874): n is a, c, g, or t
  misc_feature (3876)..(3877): n is a, c, g, or t
gtacagacgggagtatccagacgctgattgtatctggtcggtgagtgatcacggacggtcggtttatacccgaatcaggagcataagagagcaagcgagagggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60800 - DNA, 3675 bp, Homo sapiens
  misc_feature (3603)..(3603): n is a, c, g, or t
  misc_feature (3606)..(3606): n is a, c, g, or t
  misc_feature (3612)..(3612): n is a, c, g, or t
  misc_feature (3632)..(3634): n is a, c, g, or t
  misc_feature (3637)..(3637): n is a, c, g, or t
  misc_feature (3639)..(3639): n is a, c, g, or t
  misc_feature (3643)..(3643): n is a, c, g, or t
  misc_feature (3654)..(3654): n is a, c, g, or t
  misc_feature (3658)..(3658): n is a, c, g, or t
  misc_feature (3660)..(3661): n is a, c, g, or t
aagataggcagcattaaaagattttttgaaaaaagataaaaatgtagtttggaaatgtggccagtccctttcatagccaaacggtttgctttcttcttcatagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60801 - DNA, 3502 bp, Homo sapiens
  misc_feature (3430)..(3430): n is a, c, g, or t
  misc_feature (3433)..(3433): n is a, c, g, or t
  misc_feature (3439)..(3439): n is a, c, g, or t
  misc_feature (3459)..(3461): n is a, c, g, or t
  misc_feature (3464)..(3464): n is a, c, g, or t
  misc_feature (3466)..(3466): n is a, c, g, or t
  misc_feature (3470)..(3470): n is a, c, g, or t
  misc_feature (3481)..(3481): n is a, c, g, or t
  misc_feature (3485)..(3485): n is a, c, g, or t
  misc_feature (3487)..(3488): n is a, c, g, or t
acgtggccgaggatcacagccaggaaacacctagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60802 - DNA, 3256 bp, Homo sapiens
  misc_feature (3184)..(3184): n is a, c, g, or t
  misc_feature (3187)..(3187): n is a, c, g, or t
  misc_feature (3193)..(3193): n is a, c, g, or t
  misc_feature (3213)..(3215): n is a, c, g, or t
  misc_feature (3218)..(3218): n is a, c, g, or t
  misc_feature (3220)..(3220): n is a, c, g, or t
  misc_feature (3224)..(3224): n is a, c, g, or t
  misc_feature (3235)..(3235): n is a, c, g, or t
  misc_feature (3239)..(3239): n is a, c, g, or t
  misc_feature (3241)..(3242): n is a, c, g, or t
aacccagtccccagtgggccgccatgttgtgggagtgaaaggtaagggggagcgagagcgccagagagagaagatcggggggctgaaatccatcttcatcctaccgctccgccctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60803 - DNA, 3129 bp, Homo sapiens
  misc_feature (3057)..(3057): n is a, c, g, or t
  misc_feature (3060)..(3060): n is a, c, g, or t
  misc_feature (3066)..(3066): n is a, c, g, or t
  misc_feature (3086)..(3088): n is a, c, g, or t
  misc_feature (3091)..(3091): n is a, c, g, or t
  misc_feature (3093)..(3093): n is a, c, g, or t
  misc_feature (3097)..(3097): n is a, c, g, or t
  misc_feature (3108)..(3108): n is a, c, g, or t
  misc_feature (3112)..(3112): n is a, c, g, or t
  misc_feature (3114)..(3115): n is a, c, g, or t
gcggccgcggagcaagaagggcgccgcggcgtgcggcccgcgcagcccccggagccatgggcaagtgcagcgggcgctgcacgctggtcgccttctgctgcctgcagctgtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60804 - DNA, 2391 bp, Homo sapiens
  misc_feature (2319)..(2319): n is a, c, g, or t
  misc_feature (2322)..(2322): n is a, c, g, or t
  misc_feature (2328)..(2328): n is a, c, g, or t
  misc_feature (2348)..(2350): n is a, c, g, or t
  misc_feature (2353)..(2353): n is a, c, g, or t
  misc_feature (2355)..(2355): n is a, c, g, or t
  misc_feature (2359)..(2359): n is a, c, g, or t
  misc_feature (2370)..(2370): n is a, c, g, or t
  misc_feature (2374)..(2374): n is a, c, g, or t
  misc_feature (2376)..(2377): n is a, c, g, or t
gcggccgcctactactactaaaggcgcggccgcgtcgatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60805 - DNA, 3219 bp, Homo sapiens
gcggccgcggagcaagaagggcgccgcggcgtgcggcccgcgcagcccccggagccatgggcaagtgcagcgggcgctgcacgctggtcgccttctgctgcctgcagctggtggctgcgctggagcggcagatctttgacttcctgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgctctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactctttcagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccgccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctctatcttcctgtcctgcccattgggtctatagaactttctaagtgagaagtccctgcatgagggcaggcaggaatgatttgatgttgatgttatcaaatattcctggggtggccaggcacggtggctcatgcctgtaatcccaacacttttgaaggctgaggtgggcagatcacgcgaggtcaggagtttgagaccagcctggccaacatgatgaaaccctgtctctactaaaaatacaaaaattaggcagggccgggaggctgaggaaggagaatcacttgaacttgggatgcagaggtggagtgagctcagatggcgccactctaccccagcctgggtgatagagcaagactccatctcaaaacaataaaaaagaaacaaatcctggggcactggcctgtaactctgactgggtgtgtagctttaggcaactcactctccctctctatactcatccaaaaaaaaaaaaaaaaaaaagcagaggtcaaacaaaatcagtgggttcccaaatgtggcttcataatcccttagagatcttcctacttattttcctgataaaatgcattttaagtttatgctttca

SEQ ID NO: 60806 - DNA, 1808 bp, Homo sapiens
  misc_feature (38)..(38): n is a, c, g, or t
  misc_feature (1736)..(1736): n is a, c, g, or t
  misc_feature (1739)..(1739): n is a, c, g, or t
  misc_feature (1745)..(1745): n is a, c, g, or t
  misc_feature (1765)..(1767): n is a, c, g, or t
  misc_feature (1770)..(1770): n is a, c, g, or t
  misc_feature (1772)..(1772): n is a, c, g, or t
  misc_feature (1776)..(1776): n is a, c, g, or t
  misc_feature (1787)..(1787): n is a, c, g, or t
  misc_feature (1791)..(1791): n is a, c, g, or t
  misc_feature (1793)..(1794): n is a, c, g, or t
cattggcttgtgtgttgggttacatttgtcactctaanctgatgccttaagaaggttagggccacacggatttccgataaataattttaggaatcagggaactctagatgcgtctaacagcttgcctgtgccctcgacgccgtggggccacaccaacagcacagcacggtggtggggctttcttcttcctgtttatttcttattttttctattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60807 - DNA, 2469 bp, Homo sapiens
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggtaagaaccattactctaaca

SEQ ID NO: 60808 - DNA, 863 bp, Homo sapiens
  misc_feature (246)..(246): n is a, c, g, or t
  misc_feature (791)..(791): n is a, c, g, or t
  misc_feature (794)..(794): n is a, c, g, or t
  misc_feature (800)..(800): n is a, c, g, or t
  misc_feature (820)..(822): n is a, c, g, or t
  misc_feature (825)..(825): n is a, c, g, or t
  misc_feature (827)..(827): n is a, c, g, or t
  misc_feature (831)..(831): n is a, c, g, or t
  misc_feature (842)..(842): n is a, c, g, or t
  misc_feature (846)..(846): n is a, c, g, or t
  misc_feature (848)..(849): n is a, c, g, or t
cccccaggccccatgcttgtgccaacaggtcttccacagcttaatgtgatgctttgatgtttttgttgttgtttttgtttttgtattgtttttgtgtttttgttttgaattttttcctttcctgctaagattatgcccagaaaaaagttttgcatgttgtcctgctgtttcttcacaccttcgtatatatcaccttcacctctctgttttctatagtttgtgtaaactgattaatcagtttacacnaaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60809 - DNA, 3125 bp, Homo sapiens
gcggccgcggagcaagaagggcgccgcggcgtgcggcccgcgcagcccccggagccatgggcaagtgcagcgggcgctgcacgctggtcgccttctgctgcctgcagctggtggctgcgctggagcggcagatctttgacttcctgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgctctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactctttcagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccgccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaactactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctctatcttcctgtcctgcccattgggtctatagaactttctaagtgagaagtccctgcatgagggcaggcaggaatgatttgatgttgatgttatcaaatattcctggggtggccaggcacggtggctcatgcctgtaatcccaacacttttgaaggctgaggtgggcagatcacgcgaggtcaggagtttgagaccagcctggccaacatgatgaaaccctgtctctactaaaaatacaaaaattaggcagggccgggaggctgaggaaggagaatcacttgaacttgggatgcagaggtggagtgagctcagatggcgccactctaccccagcctgggtgatagagcaagactccatctcaaaacaataaaaaagaaacaaatcctggggcactggcctgtaactctgactgggtgtgtagctttaggcaactcactctccctctctatactcatccaaaaaaaaaaaaaaaaaaaagcagaggtcaaacaaaatcagtgggttcccaaatgtggcttcataatcccttagagatcttcctacttattttcctgataaaatgcattttaagtttatgctttca

SEQ ID NO: 60810 - DNA, 1106 bp, Homo sapiens
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagctaccgtactcctggtattccagactctgctatcactcaggttttctccaagtcaagaacgattgttaacgacggcccagtccaagcgtaagca

SEQ ID NO: 60811 - DNA, 773 bp, Homo sapiens
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccgggtaccagctcgattctatc

SEQ ID NO: 60812 - DNA, 268 bp, Homo sapiens
cgttcccaggacgacgctatggtggactacttctttcagaggcagcatggtgagcagcttgggggaggaggaagtggaggaggcggctataataatagcaaacatcgatggcctactggggataacattcatgcagaacatcagaggtaaaaaaaagttcactattttagctttgacattcctttataatcactgtccacttaggatatctgctttcaatgaatgtctttaaaaacttaaattgctgatttcatttggtacaaacagt

SEQ ID NO: 60813 - DNA, 355 bp, Homo sapiens
cgacaaaggtgaaaagaagaacaagggtacgtttgatggagataagctaggagatttgaaggaggagggtgatgtgatggacaagaccaatggtttaccagtgcagaatgggattgatgcagacgtcaaagattttagggtttgtatgttttacacttctgatttttgaatatgggctatgggattttgtttgttttgatttagttttactttgattttcgttttcttcccctcttcatgttttctttttaagaatccaatctagtgtaggctatgctacaaagattgtaaattaactggtgaggtggaattttctaaaaggtgtcaatgcctgaagcgttgccaaaatgataga

SEQ ID NO: 60814 - DNA, 741 bp, Homo sapiens
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcagcagagatcacaccattgcactccagcctgagtgacaagagcgaaactctgtctccaaaaaaagaaaaaagaaagattttctctttctttgggatgaagatatgcacagaatttggtgattgaattagaaatcttatatcctggaaagatgaagtaatggaggaaaagtacagagtgcctctggtttgggacacagtgattacatttgataggacacctgttgagtttgaggtagaagcagaatatctgggtgt

SEQ ID NO: 60815 - DNA, 356 bp, Homo sapiens
  misc_feature (284)..(284): n is a, c, g, or t
  misc_feature (287)..(287): n is a, c, g, or t
  misc_feature (293)..(293): n is a, c, g, or t
  misc_feature (313)..(315): n is a, c, g, or t
  misc_feature (318)..(318): n is a, c, g, or t
  misc_feature (320)..(320): n is a, c, g, or t
  misc_feature (324)..(324): n is a, c, g, or t
  misc_feature (335)..(335): n is a, c, g, or t
  misc_feature (339)..(339): n is a, c, g, or t
  misc_feature (341)..(342): n is a, c, g, or t
ggacgcgtgggtttcttctcaaaaaacacatctttaatcacccgcaccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctcaaaaaaaaaaaaaaaaaaaaaaaanaanaaaaanaaaaaacaaaacaaaaacannnaananaaanaaacacaaaanaaanannaaaacacaacaaca

SEQ ID NO: 60816 - DNA, 5554 bp, Homo sapiens
  misc_feature (5482)..(5482): n is a, c, g, or t
  misc_feature (5485)..(5485): n is a, c, g, or t
  misc_feature (5491)..(5491): n is a, c, g, or t
  misc_feature (5511)..(5513): n is a, c, g, or t
  misc_feature (5516)..(5516): n is a, c, g, or t
  misc_feature (5518)..(5518): n is a, c, g, or t
  misc_feature (5522)..(5522): n is a, c, g, or t
  misc_feature (5533)..(5533): n is a, c, g, or t
  misc_feature (5537)..(5537): n is a, c, g, or t
  misc_feature (5539)..(5540): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcaggtgagcgcacatctgagtggactcctgccagagatctaaaagtggcgactgatagtgagattcttaaactgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60817 - DNA, 5384 bp, Homo sapiens
  misc_feature (5312)..(5312): n is a, c, g, or t
  misc_feature (5315)..(5315): n is a, c, g, or t
  misc_feature (5321)..(5321): n is a, c, g, or t
  misc_feature (5341)..(5343): n is a, c, g, or t
  misc_feature (5346)..(5346): n is a, c, g, or t
  misc_feature (5348)..(5348): n is a, c, g, or t
  misc_feature (5352)..(5352): n is a, c, g, or t
  misc_feature (5363)..(5363): n is a, c, g, or t
  misc_feature (5367)..(5367): n is a, c, g, or t
  misc_feature (5369)..(5370): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60818 - DNA, 5391 bp, Homo sapiens
  misc_feature (5319)..(5319): n is a, c, g, or t
  misc_feature (5322)..(5322): n is a, c, g, or t
  misc_feature (5328)..(5328): n is a, c, g, or t
  misc_feature (5348)..(5350): n is a, c, g, or t
  misc_feature (5353)..(5353): n is a, c, g, or t
  misc_feature (5355)..(5355): n is a, c, g, or t
  misc_feature (5359)..(5359): n is a, c, g, or t
  misc_feature (5370)..(5370): n is a, c, g, or t
  misc_feature (5374)..(5374): n is a, c, g, or t
  misc_feature (5376)..(5377): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60819 - DNA, 5031 bp, Homo sapiens
  misc_feature (4959)..(4959): n is a, c, g, or t
  misc_feature (4962)..(4962): n is a, c, g, or t
  misc_feature (4968)..(4968): n is a, c, g, or t
  misc_feature (4988)..(4990): n is a, c, g, or t
  misc_feature (4993)..(4993): n is a, c, g, or t
  misc_feature (4995)..(4995): n is a, c, g, or t
  misc_feature (4999)..(4999): n is a, c, g, or t
  misc_feature (5010)..(5010): n is a, c, g, or t
  misc_feature (5014)..(5014): n is a, c, g, or t
  misc_feature (5016)..(5017): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60820 - DNA, 4121 bp, Homo sapiens
  misc_feature (4049)..(4049): n is a, c, g, or t
  misc_feature (4052)..(4052): n is a, c, g, or t
  misc_feature (4058)..(4058): n is a, c, g, or t
  misc_feature (4078)..(4080): n is a, c, g, or t
  misc_feature (4083)..(4083): n is a, c, g, or t
  misc_feature (4085)..(4085): n is a, c, g, or t
  misc_feature (4089)..(4089): n is a, c, g, or t
  misc_feature (4100)..(4100): n is a, c, g, or t
  misc_feature (4104)..(4104): n is a, c, g, or t
  misc_feature (4106)..(4107): n is a, c, g, or t
ggctgagatgagcctcagtagttcagactttctttacctttcttttgctatttttaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggtgcggctgcattgttattcctaatactttggcagggaaaaaggctgcacgtttgaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctgaaaaaaaaaaaaaaaaaaaaaaaanaanaaaaanaaaaaacaaaacaaaaacannnaananaaanaaacacaaaanaaanannaaaacacaacaaca

SEQ ID NO: 60821 - DNA, 3768 bp, Homo sapiens
  misc_feature (3741)..(3741): n is a, c, g, or t
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcgnttgctcaagaatactcccctcttcaaa

SEQ ID NO: 60822 - DNA, 3533 bp, Homo sapiens
aacccagtccccagtgggccgccatgttgtgggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacagcataaatgcattatatctcatcggctgcttctttatttatgtcactatctcttgtgttaaaaaaagcctggggaggttctgtgggcaactgggttctccactgggcaaccccccgggaaagaaggaatttatgtcccaagggaacaagatgctgctgaccttccacacagacttctccaacgaggagaatgggaccattatgttctacaagggcttcctggcctactaccaagctgtggaccttgatgaatgtgcttcccggagcaaatcaggagaggaggatccccagcccca

SEQ ID NO: 60823 - DNA, 1538 bp, Homo sapiens
ggctaggagaggacgtggggtgaatcggacgaggctgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctctatcttcctgtcctgcccattgggtctatagaactttctaagtgagaagtccctgcatgagggcaggcaggaatgatttgatgttgatgttatcaaatattcctggggtggccaggcacggtggctcatgcctgtaatcccaacacttttgaaggctgaggtgggcagatcacgcgaggtcaggagtttgagaccagcctggccaacatgatgaaaccctgtctctactaaaaatacaaaaattaggcagggccgggaggctgaggaaggagaatcacttgaacttgggatgcagaggtggagtgagctcagatggcgccactctaccccagcctgggtgatagagcaagactccatctcaaaacaataaaaaagaaacaaatcctggggcactggcctgtaactctgactgggtgtgtagctttaggcaactcactctccctctctatactcatccaaaaaaaaaaaaaaaaaaaagcagaggtcaaacaaaatcagtgggttcccaaatgtggcttcataatcccttagagatcttcctacttattttcctgataaaatgcattttaagtttatgctttca

SEQ ID NO: 60824 - DNA, 4168 bp, Homo sapiens
cgtagcgcccgcagagcaacgcaaagaggaagaacagagaaacggctatgagaaaaagggccgaagagtgagaagcagagggccttacccgagggggcggcaaccgggggccccacggtcctccggccgcgcccgcgctggcgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttcgccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 60825 - DNA, 4452 bp, Homo sapiens
cgtagcgcccgcagagcaacgcaaagaggaagaacagagaaacggctatgagaaaaagggccgaagagtgagaagcagagggccttacccgagggggcggcaaccgggggccccacggtcctccggccgcgcccgcgctggcgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttcgccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcaggtaggggacaccacccctttctccctgccagggctgtggcattcctgaccttcaccttcaggtagtcccccaggtgaccccctccagccctgtaagtgccccaaggatggaaaatggctgccttcttgatctggtccttccctgtcctggagcaggaaggcaggccttaacctctccttctttcctgcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 60826 - DNA, 3966 bp, Homo sapiens
  misc_feature (3766)..(3766): n is a, c, g, or t
cgtagcgcccgcagagcaacgcaaagaggaagaacagagaaacggctatgagaaaaagggccgaagagtgagaagcagagggccttacccgagggggcggcaaccgggggccccacggtcctccggccgcgcccgcgctggcgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttcgccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgggagtttcctccagcctgagggagaccatgaagtggtggggttgtagtgagggggctcccccagcctaagggagactgtgaagtggaggttgtagtaagagggcttccacagcctgagggaggcttctgggggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggggaaagatgaaacacatagatnatcctggaaaatttttctgattaataaaattctccatcctttgtgtgctccaggaacagtttatggaaagaaacacccttcccattatgagttagatggtgctctcttttcttacctatcacacagccagacacacactctgcacattttctctttctcattaaaaaaaaatcagctgaatttgttttcagtggtcataa

SEQ ID NO: 60827 - DNA, 3865 bp, Homo sapiens
cgtagcgcccgcagagcaacgcaaagaggaagaacagagaaacggctatgagaaaaagggccgaagagtgagaagcagagggccttacccgagggggcggcaaccgggggccccacggtcctccggccgcgcccgcgctggcgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttcgccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagcccttgtcctcagctgcacccctgcttaccgggcgccaccgcgacaggcctgacggcgtggctctcttgcagtaccctgcaccgctgccggcgagcgacttgccgaattcacgacacgcgactgcgagccgcgcttgcgccttccttactgtccggaatccgtcacttgctgctgcttccctgcaactacccattcacgcgagctaccacgcgtgcctcccgaaacccctgagcgctttacaccgttgcgcaccgctaaggcgccgctcgcacccattgcctcgaatcgcccttgcgccacgccggcctgggccctggagcccctatgggtggcaccactgccactcccacaggtcccaattgtaccgctttggcctcccactatccacctctcacaccccctctactt

SEQ ID NO: 60828 - DNA, 284 bp, Homo sapiens
gcagtggttggggcaggggggctaggggacagcagtgtgtccaatgcccaccctttttcttgcaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcag

SEQ ID NO: 60829 - DNA, 4413 bp, Homo sapiens
cgtagcgcccgcagagcaacgcaaagaggaagaacagagaaacggctatgagaaaaagggccgaagagtgagaagcagagggccttacccgagggggcggcaaccgggggccccacggtcctccggccgcgcccgcgctggcgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttcgccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgggagtttcctccagcctgagggagaccatgaagtggtggggttgtagtgagggggctcccccagcctaagggagactgtgaagtggaggttgtagtaagagggcttccacagcctgagggaggcttctgggggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 60830 - DNA, 4262 bp, Homo sapiens
cgtagcgcccgcagagcaacgcaaagaggaagaacagagaaacggctatgagaaaaagggccgaagagtgagaagcagagggccttacccgagggggcggcaaccgggggccccacggtcctccggccgcgcccgcgctggcgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttcgccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 60831 - DNA, 835 bp, Homo sapiens
ggagaaggctgacgggtggctctctgcagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 60832 - DNA, 444 bp, Homo sapiens
ggttgcagtgaacccgaatggtgccactgcactccagcatgggtgatagagagagactgtctcaaaaaaaaaaaaaaaaaagttaaaatagctaaaattatttttagtaatatattttatttatcccagtttatacaaaatatcatttcaacatgttgtcaatattaaaattactgagatattaaaaaaaatcttggtactaagtctttgaaatctggtattttacacctaaagcacatctcaattcacagaagccacatttcaaatcttcaactgtcacatgtggccactggctagtactggacagtgcaactctagaatatttaaattataaagtaatacttagaacttttatcaggaaattgaggtaaaactcacacttacacttaaagctttagtaaaattagagacgctgatcataacattcatgagactggatgcaaa

SEQ ID NO: 60833 - DNA, 691 bp, Homo sapiens
taggacttttaccttaaagtggaatacttcagaccttgaagtggaatacttctagtcagactaggtaaaaacttgggtcataccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60834 - DNA, 691 bp, Homo sapiens
gaaaaactactttaatgtcatatggaccacaaaagagctgcatagccaagcaatcctaagcaatgagaacaaagctggagaatcatactatctgacttcctgatgggagaagatgcgcctcttggctccctcaggtatctgcttggttatcttaccaggtctcctatggctactctctataaaacaagccccatcatcccctagtctctaggctccttaccccgccttcttttgcatagcactgatcagcagctggcgttttatttatgcatatctaattatcgaaccacctccagctctcttgtgcaatgctgtatcctcagtgtaacagacagaaattattctataaacatctgtggaataaatgcataactggttctataaacatcatgctgatgggagcaagactggcgcatcttctcccatcaggaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctatggacgcaactcgcggggtcctctggcgtcgctccgc

SEQ ID NO: 60835 - DNA, 3457 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaatgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60836 - DNA, 3700 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcagaaaaaaaaatataatacatgtagatacgagacaaaaaaaaaaaaaaatgaaaaaaaataaaaaaaaaagagagggggacagatatatattcaggggagagaaaaaagacagattatagaaaggcccaaaataaaaaaagaagaaggggtataaatcggaaaaatgtgtgtaagacaactgtggagaaaac

SEQ ID NO: 60837 - DNA, 3395 bp, Homo sapiens
atccttaattaaattaatccccgcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60838 - DNA, 3986 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtaagtataaatttcacctactacttaactccccttatttgggagatgttagatttctaagaccaaatctagtgtcaagcatgttggtggtagatcacagaaaattttatcttgaggctctctaatctgctattgtccattgacttgaaagatgtatgggttgaggctacagttcttccagaagtatttgttaatttcatactggctttcctggcttctgttttcatggttttttaattcttgacctacagttgaaccataaatacctggttgatgaagtaacttgttttgtggcatgactttcacaagctctgtcattccccacaagatgaaaactcacatgcctgcaatattaaaactaagttatattccctactgcaatattaacactttgagttagatcctttttatagcttcccacacgctgtagctttggatcagttaaacttctgaactattgttacaccctacataggtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60839 - DNA, 3004 bp, Homo sapiens
ctgctacttggcttttaataaatgagaaaacaattatatacacttaaagatttgaatcctaattaggcctgctgtttagtgtaataaaaacataggctttaaacactgtaaaactgtaaaataaatctttcagggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtaagtataaatttcacctactacttaactccccttatttgggagatgttagatttctaagaccaaatctagtgtcaagcatgttggtggtagatcacagaaaattttatcttgaggctctctaatctgctattgtccattgacttgaaagatgtatgggttgaggctacagttcttccagaagtatttgttaatttcatactggctttcctggcttctgttttcatggttttttaattcttgacctacagttgaaccataaatacctggttgatgaagtaacttgttttgtggcatgactttcacaagctctgtcattccccacaagatgaaaactcacatgcctgcaatattaaaactaagttatattccctactgcaatattaacactttgagttagatcctttttatagcttcccacacgctgtagctttggatcagttaaacttctgaactattgttacaccctacataggtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60840 - DNA, 2951 bp, Homo sapiens
ctgctacttggcttttaataaatgagaaaacaattatatacacttaaagatttgaatcctaattaggcctgctgtttagtgtaataaaaacataggctttaaacactgtaaaactgtaaaataaatctttcagggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtaagtataaatttcacctactacttaactccccttatttgggagatgttagatttctaagaccaaatctagtgtcaagcatgttggtggtagatcacatgtatgggttgaggctacagttcttccagaagtatttgttaatttcatactggctttcctggcttctgttttcatggttttttaattcttgacctacagttgaaccataaatacctggttgatgaagtaacttgttttgtggcatgactttcacaagctctgtcattccccacaagatgaaaactcacatgcctgcaatattaaaactaagttatattccctactgcaatattaacactttgagttagatcctttttatagcttcccacacgctgtagctttggatcagttaaacttctgaactattgttacaccctacataggtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60841 - DNA, 2161 bp, Homo sapiens
  misc_feature (22)..(22): n is a, c, g, or t
tggctggtacggtcagccgttntgatcaggatgctacagccgcggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60842 - DNA, 1829 bp, Homo sapiens
aaaagcccagatatgaccaccatacccccaccccatgcccaccccagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60843 - DNA, 1642 bp, Homo sapiens
cttcatacctctacggccatttgtatgcagttttacagagcccttaacatcattcgagtacatttggcattggccagaccacaacaggaagcatgtcagcaaatagagcaaagagactttcccaagtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60844 - DNA, 1521 bp, Homo sapiens
cgtgacgcgtgggtcgacccacgcgtccgtcctctgctgccgctcggtcacgcttgtgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60845 - DNA, 1486 bp, Homo sapiens
acgcgtccgcggacgcgtgggtgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60846 - DNA, 1228 bp, Homo sapiens
cggtaccggtccgccagctgttggataaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60847 - DNA, 1855 bp, Homo sapiens
  misc_feature (1812)..(1812): n is a, c, g, or t
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagtaaatattttgggacttgcgagccacatatggtctctgtcacatattcttcttacttttttaagataacttgtacaatatgtnaaaacaatttttagcttgcgagccctacaaaaacagactgcag

SEQ ID NO: 60848 - DNA, 1683 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttgggtaaaaatattaaatgttctttaagttaacccatttggagggctgatatcattaaggatgctacatatacgataaggatatcaagactttactcagtactaatctgatgtcagtgaaaattattgggatatatgaaacttatctttagctttattaccagatga

SEQ ID NO: 60849 - DNA, 2361 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtaagtataaatttcacctactacttaactccccttatttgggagatgttagatttctaagaccaaatctagtgtcaagcatgttggtggtagatcacagaaaattttatcttgaggctctctaatctgctattgtccattgacttgaaagatgtatgggttgaggctacagttcttccagaagtatttgttaatttcatactggctttcctggcttctgttttcatggttttttaattcttgacctacagttgaaccataaatacctggttgatgaagtaacttgttttgtggcatgactttcacaagctctgtcattccccacaagatgaaaactcacatgcctgcaatattaaaactaagttatattccctactgcaatattaacactttgagttagatcctttttatagcttcccacacgctgtagctttggatcagttaaacttctgaactattgttacaccctacataggtactcacctcagcaattagcagggaagagaattggagtgttttcttatggttctggtttggctgccactctgtactctcttaaagtcacacaagatgctacaccgggtaagtgctgaatctttcaacaagaatgtattgagaactgagtccaggcacagtggctcacacccgtaatcccagcagtttgggaggccgaggcgggcagatcacctgaggtcaggagttcgagaccagtctggctaacatggctgaaaccccatctctactaaaaatacaaaaattagccaggtgaggtggtgcatgcctgtagtcctagctacttgggaggctgaagtaggagaatcacttgaatccaggagagggaggttgtggtgagccaagatcacaccactgtgctccagcctgggtgacagagcgagactctgtcaaaaaaaaaaaaaaaaaatgtattgagaactactctggggaagttgatttagcagtcttctcaagtgagcacctgaatctgtcccacagatcattacaatattttagtcttcattacttctttcagtaggtttttactctctgccctaaaaatctatccaaaaaaaaaaaa

SEQ ID NO: 60850 - DNA, 425 bp, Homo sapiens
atagtcactggcaattttaatttgtcttcagtgtagtagagtaactgtgaactgttagagttatgaaactgacatggaaagttgtataccaaaggagtcttaggactgtccatggatactgttatgtatcatttcacttatattggcttcagcttgcgatttctctactgtaagtggtgagaattgatcagatagttaaggaaggtccttagataatgcagtatacttattaacatacagacatcaagaagcagaaatatatagacatcttcctttttggttctaatagggcttcgtgggacacatatgcaacatgcctatgatttttacaagcctgatatgctatctgaatatcctatagtagatggaaaactctccatacagtgctacctcagtgcattagaccgctgctattctgtctactg

SEQ ID NO: 60851 - DNA, 3511 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60852 - DNA, 3452 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60853 - DNA, 3367 bp, Homo sapiens
cgtgacgcgtgggtcgacccacgcgtccgtcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60854 - DNA, 3400 bp, Homo sapiens
atccttaattaaattaatccccgcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60855 - DNA, 3835 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggtatgttacatgcctattccccgccgtcccccaaaatttttttctaaggttcaatagacccagatgacactttaattaatgcaatacgcaaacttttgtaatttgtccttgtttggatatattaagaaagatattttacctgtctgtcattatccgaattgtgaattggttatcttatcttgtaggacaaatggtctattcaaaatttagtcagatggatgacagagccttggcagatgaattttaaaaaaaaattagagcattttctttctttatcaaagaagggaaaagcatattctggggaaaatataacagacttcagtttccatgtttggttatagtgttgaattccttcttgtgaaataacaaagaatatttttcaggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcaga

SEQ ID NO: 60856 - DNA, 2150 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgt

SEQ ID NO: 60857 - DNA, 2153 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgaggtaaataaaagagttcccatctccatatcttagggtttaggagacctaactgggatttagcaacataaataaatgtcagtaaagaagagtaagggctctgggagtagattctagctgtactatttccaattgtataaagtgctttgcatttgaattattaatattttaagaatatacagtaaaggccgggtgcggtggctcacgcctgtaatcccagcactttgggagactgaggcaggcagatcacgaggtcaggagatcaagaccatcctgtccaacatggtgaaaccctgtctctactaaaaatacaaaaattagttgggcttggtggcacgtgcctgtaattccagctactcaggaggctgagtcaggagaatggcttgaaccagggagtcagaggttgcagtaagctgagatcacaccactgcactccagcctggcgacagagcaagattccatctcaaaaaaaa

SEQ ID NO: 60858 - DNA, 1886 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccgggtaagtgctgaatctttcaacaagaatgtattgagaactgagtccaggcacagtggctcacacccgtaatcccagcagtttgggaggccgaggcgggcagatcacctgaggtcaggagttcgagaccagtctggctaacatggctgaaaccccatctctactaaaaatacaaaaattagccaggtgaggtggtgcatgcctgtagtcctagctacttgggaggctgaagtaggagaatcacttgaatccaggagagggaggttgtggtgagccaagatcacaccactgtgctccagcctgggtgacagagcgagactctgtcaaaaaaaaaaaaaaaaaatgtattgagaactactctggggaagttgatttagcagtcttctcaagtgagcacctgaatctgtcccacagatcattacaatattttagtcttcattacttctttcagtaggtttttactctctgccctaaaaatctatccaaaaaaaaaaaa

SEQ ID NO: 60859 - DNA, 1031 bp, Homo sapiens
accgtcccgcctcccagcgactctcggcggtgccggagtcgggtgggttggcggctataaagctggtggcgaaggggaggcgccgcggactgtcctttcgtggctcactccctttcctctgctgccgctcggtcacgcttgtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggtcttctcaacaccataatcagaactaccctggaagctccctcaaagaatacatcctgggtttgactatcctaaactgttggaagtgccttaattgtaatgacggctgaaatgtattcttgccagttgctctgacatggattggttgatttcactcatcttgactcattacacgtgaccaggacctttcttctttccgtaaaagcggtggactttggttctcccatggtacacaatccccccaggaaccgtgcccgtgtgacaccgaggcggaggttaacaccacgtctctgacgtccaagacccaactggggcaaaacgccacggttcaaaaaagccgtagattttgg

SEQ ID NO: 60860 - DNA, 477 bp, Homo sapiens
tagcccattctggctaaatgaaacaagggggattggcagggagcttatgggaaacgttgtccttatgataaaaagagatgcataggaggaaataccccttttcttcccatgggcattgtcacgtggtacctggaactatgacaccacttagtgaccatgaagcccaagccaatacgttgaagataccatatgagccacaggagaaaagactttatgtttggtgacattactgagttgctgacttaggactacaatgccccaacttccaaaatcttgttatgtgacagtcaattccttacttacaaaatttctttaattggatctcttgttccttgcagctaaaggaattctgacaaaataaatcaaaactcaaaatgtgcatacccttggaacacaaaatgtaatttctagagctctgactcaaggaaatattcagacaagtaaacagaggtatatataacatgctatttatagtac

SEQ ID NO: 60861 - DNA, 321 bp, Homo sapiens
gtcttgtcttaactatccatatatctctatagtggtccccattttacagttggggaacagaagcttaaagagaagcaacgttgccagcccaaggtcacagtagtggcccaggatgagattgggactcaagaaatccaagagcagccaggtgcagtggctcacacctgtaatccaagccacttgagaggctgaggagggaggattgcttgagcccagaaagtcaaggctacagctagctatggttgcaccactgcacttcagcctggacaagagagagagaccctatctccaaaacaaacaggccgggtgaagtagctcacg

SEQ ID NO: 60862 - DNA, 247 bp, Homo sapiens
ggacactagtgctcagaaggtcagatttatttagagatcgcaaagataacgagttcataacaaaagacaagtgagtaattaaatatcagcaagtcacaagaataataaaccctgtattggctcctatcaaactaggcccagtgctgggcacttggactcatgatctcattcctgtgtacctttcagactctggagcgtacaaaaatgcttggaaacagcttgcaaattacaaattcattaaatgcaa

SEQ ID NO: 60863 - DNA, 537 bp, Homo sapiens
accttctttggtaacgtgaacgagtcggcggtggtgcgccatgacctgcacttccacttcactgcgcgctacatccgcatcgtgcccctggcctggaacccacgcggcaagatcggcctgaggctcggcctctatggctgcccatacaaggccgacatactctatttcgacggcgacgatgccatctcctaccgcttcccgcgaggggtcagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgag

SEQ ID NO: 60864 - DNA, 366 bp, Homo sapiens
cctcccaggctcatgtgcagcagcaggtgtgccccttccagccgaagcctgtgggacgtgttcgccttcagcttcaagaccgaggagaaggacggtcttctgctgcacgccgagggcgcccagggcgactacgtgacgctcgagctggagggggcacacctgctgctgcacatgagcctgggcagcagccctatccagccaagaccaggtcacaccaccgtgagcgcaggcggagtcctcaatgaccagcactggcactatgtgcgggtggaccgatttggccgcgatgtaaatttcaccctggacggctatgtgcagcgctttattctcaatggagacttcgagaggctgaacctggacactgag

SEQ ID NO: 60865 - DNA, 885 bp, Homo sapiens
agactggcaccagtccatggcctactcattgagtggcactcctccaaacctatctttaccagttactgcaactctagccaatctctgaccaacccctcctatctttcacagctcattctttctagaaggtactcttcagtcccactggcccacactgatcttatcaccatgtcactatcccacttccctaatatttatctttctttcttgctcagcttaaatttcatgacttatcattgtaattactcccttgcatacaccctcaacttccttgtccctctcttacttcctcgtatttgttaaatccagctctctgcctggtccatgaactgcacctgtgcaccctgaatgtggcctagagacagcacacaagcatcctcactggctttgctttaaattcatgactatgaacctcaagtggactcttaatgacatctggcagttatacttacatttcctttgtccatttagtttcccactatcctaggtcattattttgcactttgtactctcccttcaaaattctgacactattcccctcctcctcactttcagctgatgaccctgcttcttgctttactgtcaaaattgcagcaatccagccgggcacggtggctcatgcctgtaatcctagcactttgggagaccgaagcgggtggattgcttaagcctaggagctcgagactagcctgggcaacatggcgataccccctcgctgctaaaaatacaaaaaattagctgggtgtggtggcacacacctgtggtctcagccactccggaggctaaggtgggaggatcatctgagcccaggaagtcaaggctgcagtgagccatgatctagccactgcactccagcctgggtgacaaaaatgagaccctttctca

SEQ ID NO: 60866 - DNA, 493 bp, Homo sapiens
ctagtggattaccaaaatattccagctgatctcgtgctcccaacttcatctgcactagtcttccttcggctccttggacatgctaagctcatttaccttttaggttccctctgcccgcaagatgtttacatggctgttatatcatctagatcttagctaggacaggatcttctcagggagacctttatgaccacccaatagaaagcaaccagggccaggcacggtggctcacgcctgtaatcccagcactttgggaggccaaggtgggcggatcacgaggtcaggagattgagaccatcctgactaacatggtgaaaccccatctgtactaaaaatacaaaaaattacactggtgtggtggcacatgcctgtagtcccagctacttgggaggctgaggcaggagaatcgcttgaacccgggaggtggaggttgcagtagctgagatcacgccactgcactccagcctggtgacagagtgaaactccgtctcaa

SEQ ID NO: 60867 - DNA, 467 bp, Homo sapiens
ggcacaatcaagggtgaatggggcaggaaggatgggcttcttgtcttccaaactaaagcttttgtgtctgagagcaaacctagctgcaaaggggcggcaaatagagaaacctggggtggtggtaaagaaatattcccagcaggaaaaccagagagcttgtctgacaagcatttgttaactgaattgatctgattactcaggacttttcttagccaggactgggggcagagaggggctgcagttgcttttcattctatttaatttctgttttccaagaatgaatatcaagggagcagctttgattaaacaagcctttaaaaagggggagaaaatgccaggttttacagagagccttgctgagtcgctggcaaatggccacatgacacaatatttttagtctttggatattatctcctctctaagtacaaaactgctattcccattaacacagctcttaggttcagaga

SEQ ID NO: 60868 - DNA, 571 bp, Homo sapiens
aagagaaatgtaaacagacatttacacaaaggctagcatgtaaatgttcatagcagcactattcctaatagccaaaaagtggaagcaacccaaacatcaatcaacactacagtggaatactattcaataatagaaaggagggaaatactgatgcatgctacaacatgggtgactctcaaaaaaattatgctcagtgaaagaagccagacacaaaagaccacatagtctatggttctatttatatgaaatgtccagaaaaggcaaatctatatagacagaaaatagattaatgattgcctggggctgggggtgggaatggagactgattataactgggcacgggtaatctttttgaggtggtagattttattgaggtgatggaaatgttccaaaactggattgggtgatagttgcatgcgtttgtaaatttatttaaaaatcattaaattatattattaaaaagaacattgttaatgatagcatatatctaaatgtaaacaatttttgtgcatataaagcatttagcacagtgtttgaaatataacagctcaataaatgtagttaactttga

SEQ ID NO: 60869 - DNA, 344 bp, Homo sapiens
gtttcctcaagcctaacaagatggtggcttcctgcttagcaggtggtcttccaggaacccaaagccccggacccaatagtgggttcaacagaactatccagcagctgcttcaccagagtgtgtgaggtggaagagaagagagaaggacagaagcagcccatggcactgatgagaacactccattctcctcaacccccaggaaaaaaaaacacttgagagacaaggcctgatagaaaacaaatttttgagaacaatgtccccagatagcgcagaaagctgccaaaggagttcctcgtgctctcctatgaagcagtgtgtctccgctatagactgaatgtttgtgt

SEQ ID NO: 60870 - DNA, 1124 bp, Homo sapiens
agttttgctaccttgctcaggctggtctcaaattcctggcctcaaatgatcctcctgcctaggtctcccaaggtgctgggattacaggcgtgagccactacagtatgcaggaacctaaaatatctgtccagcctgggcgacggagcgagactctgtctcaaaacaaacaaacaaacaaaagacccaatctgagtcttatcgttgtactgatagaagggtcagatatccccacatggagttgagtgggagaaagagattcactagagaataactccttagagaccaatgtctgtagcaggtgtacagcatcttgtgaaagttatggagcatgaaaagactgaagggccaggacagtttgcatgggctgagttataccagctagaccaggaatagaacaaagaattctatacctcaggatttcaaaaagttagcaacttgagaggccagtgctgagcaacccagtacccaggaaatgaaaaaaagaaagaaaattccctccgagaatgaacaaatcattggcttcattgcctcatgagcttgagagaaaggagaagagagccagagtgtggcaagtgaggccaaaatcagaagcatggcagaaatgagtgtaagtgattgagccacagacagaagtgtggcgagggacaatgccatattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttctgt

SEQ ID NO: 60871 - DNA, 1032 bp, Homo sapiens
ggttttggagaccagagtcttcgctccgtcgcccaggctggagtgcagtggcgcgagactctgtctcaaaacaaacaaacaaacaaaagacccaatctgagtcttatcgttgtactgatagaagggtcagatatccccacatggagttgagtgggagaaagagattcactagagaataactccttagagaccaatgtctgtagcaggtgtacagcatcttgtgaaagttatggagcatgaaaagactgaagggccaggacagtttgcatgggctgagttataccagctagaccaggaatagaacaaagaattctatacctcaggatttcaaaaagttagcaacttgagaggccagtgctgagcaacccagtacccaggaaatgaaaaaaagaaagaaaattccctccgagaatgaacaaatcattggcttcattgcctcatgagcttgagagaaaggagaagagagccagagtgtggcaagtgaggccaaaatcagaagcatggcagaaatgagtgtaagtgattgagccacagacagaagtgtggcgagggacaatgccatattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttctgt

SEQ ID NO: 60872 - DNA, 344 bp, Homo sapiens
cgtgctttcccacagagaccgttcttgttacctccaaaatctcatgattccccctctagttatatttcttccctctcctccaccattttgattcctgatctatagaactttgtgtctctcagtttggagtggaggctaaggacatgagagttgagagtctgacatccctgagtgtccaatatcccaggaattccagatgcgtgcctaggatcctatgctttcctcaattctccacttatctccccctcccttcccataatgctggatgagactgtagctactggctcagagatatttttagtcaagtcagaccacattgtctactggggtggggttgggggcag

SEQ ID NO: 60873 - DNA, 402 bp, Homo sapiens
tttagtcaagtcagaccacattgtctactggggtggggttgggggcagggaaggcaggtgcccacatccatcacaccggcacttgtggggcagcccagagaagggagagggccaggctccaaaaatagcacagtgagctcattcagctgccagctctggggacaagacaaaggggctttaaaaggcgtggggggtggctcaagctggtcctgctccagccaacaccgcctttctcagcatggagacctttgagcccatcagccaagagcccctcagccaagccagctatgacaaagccccagacccagttcctgagctccaagactcgttctatgcaggtactaccctcccatatctatgagagtctggggtctagaatggaggggaagatgtcaatagttt

SEQ ID NO: 60874 - DNA, 4126 bp, Homo sapiens
agccaacaccgcctttctcagcatggagacctttgagcccatcagccaagagcccctcagccaagccagctatgacaaagccccagacccagttcctgagctccaagactcgttctatgcagaactgcaacgtgcagagagcctccaagagaagagcataaaagaggccaagaccaaatgcaggacaattgcatccctgctcactgcagcccccaacccccactccaaaggggtacttatgtttaagaaacggcggcagagagccaagaagtacaccctggtgagcttcggggctgctgctgggacaggcgctgaggaggaggacggcgttccccccacgagtgagtccgagctggacgaagaagccttctctgacgcccgcagcctcaccaatcaatctgactgggacagtccctatctggacatggagcttgccagggcgggctcaagagcatcagagggccagggctctgggctgggagggcagctgagtgaggtctctgggcgaggggtgcagctctttgaacagcagcgccagcgcgcagactccagcacccaggaactggcacgggtcgaaccagcagccatgctcaacggggaaggcctgcagtcaccacctcgggcccagagtgctcccccagaggcagctgtgctcccacccagccccttgccggcgcctgtagccagccccagacccttccaaccaggtggtggagccccgaccccagctccaagcatctttaaccggtcagccaggccctttaccccgggcctacaagggcagcggccaactaccacctcggttattttccggcctttagcccccaaaagggcgaacgacagcctggggggcctcagccccgccccaccccccttcttgtcttcgcaggggcccacccctctgcccagcttcacttcaggggttcccagccacgcgccagtctctggttcccccagcaccccacgctcctcgggccctgtgacagccaccagctccctgtacatcccagcccctagtcggcctgtcaccccaggtggagctccagagccccccgctcctcctagcgcagctgccatgacctccaccgcttctatcttcctatctgcgcctttgcgaccctctgcgcgcccagaggcgcctgccccaggcccaggggctcctgagccccccagcgctcgcgagcagcgcatctctgtgccagctgcccgcacgggtatcctgcaggaggcccggcgccgggggacccggaagcagatgttccggccgggaaaggaggagacgaagaactcgcccaaccccgagctgctatcgctggtacagaacctggatgaaaagcctcgggccgggggtgcagaatctggtcctgaagaagatgctctgagcctcggggctgaagcctgcaacttcatgcagccagtaggggccaggagttacaagaccctgcctcacgtgacacctaagaccccccctccaatggctcccaagaccccgccccctatgactcctaagactccacccccagtggctcctaagcccccatctcgagggctccttgatgggctcgtgaatggggcagcctcttcggctggaacccctgagccaccaaggctgcagggcaggggtggggagctgtttgctaagcggcagagccgtgcggacaggtatgtggtggaaggtacacctggtcctggtcttggccctcggcctagaagtccttctcctaccccgtctctgcccccttcctggaaatattcacccaacatccgtgccccgcctcctattgcttacaacccactgctctctccctttttcccccaggcggcccgaactctccctaaggcccaatcccaggggcctcgggcaacacccaagcagggcatcaaggctctagattttatgcggcatcagccctatcaacttaaaactgccatgttctgttttgatgaggttcccccgactcctggccctatcgcctcagggtcccccaaaactgcccgagtccaggagattcgccggttttccactccggcaccccagcccactgcagaacccctggctcccactgtgcttgccccccgagcagccactacactggatgagcccatctggagaacagaactggcctcagcccctgttcctagcccagcccctcctccagaggctcccaggggccttggggcttctcccagctcctgcggtttccaggtagccaggccccgattttcagccaccagaacaggattgcaagctcatgtgtggaggcctggggcagggcaccagtgaacaggcacaggtcccaggaccaaggagaggtggaacatccagttcctaaagttgcttctcctaccctatcccatcccctgtcacgcatctggaagctaaattgcctcctgccagagatggtttccaagttgatgtccccttcccccaccttcctcctcactctctacctccctgccgctttccaaccaagtatgtctgctttggtatctttgcctctctttgtctctgcatttcctttcctggatctctgtctttatttccaggcttctccacccatattcctccacagatctctcttccttgacatttgtgcttttctccctgggcctcattttaatgttcagtgagaagtaaacagagcagaagtgaccactgggacttcaggcaagaagctcaccaccaggcacacagcaaagggactgaactgacccctgtttgcactaagccacccccaccccccactctgctttcccaagcttgactggcatatacctaggcctgtgtgtgtgtgtgtgtgtgtgtgtgtgtgtgtgtgtgtgtgctcttccgtctaaggcatgaataagaggggaggtcaaaataaagacccaatctgaggccgggcacggtggctcacgccggtaatcccagcactttgggaggccgaggcgggcggatcacgaggtcaggagatcgagaccatcctggctaacacggtgaaaccccatttccactaaaaatacaaaaaattagctgggcgtggtggcgagcgcctgtagtcccagctactcgggaggctgaggcaggagaatggcatgaacctggaaggcggagcttgcagtgagctgagattgcgccactgcactccagcctgggcgacggagcgagactctgtctcaaaacaaacaaacaaacaaaagacccaatctgagtcttatcgttgtactgatagaagggtcagatatccccacatggagttgagtgggagaaagagattcactagagaataactccttagagaccaatgtctgtagcaggtgtacagcatcttgtgaaagttatggagcatgaaaagactgaagggccaggacagtttgcatgggctgagttataccagctagaccaggaatagaacaaagaattctatacctcaggatttcaaaaagttagcaacttgagaggccagtgctgagcaacccagtacccaggaaatgaaaaaaagaaagaaaattccctccgagaatgaacaaatcattggcttcattgcctcatgagcttgagagaaaggagaagagagccagagtgtggcaagtgaggccaaaatcagaagcatggcagaaatgagtgtaagtgattgagccacagacagaagtgtggcgagggacaatgccatattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttctgt

SEQ ID NO: 60875 - DNA, 267 bp, Homo sapiens
gccatttgggttcccaaggtacttgctttagttggcatttcatcatcaccaaccacaggtgatagcctgattaactgtgatgcccctgcatatgtgggattattaccaaactagttcctgcttgagccctatactcaagcctaaggacacaacgaaaagcaattctgaatcccatttttgtgtgcctgtctcctatgaccactgccactaccagtcctgtatcagaggacagaaaccacacagtaatttgaatatggaaagtttaac

SEQ ID NO: 60876 - DNA, 383 bp, Homo sapiens
gtgcactgtgcagctcatggtgttatgggaacttagtgatcttggccagataccgagttaggggtaatcagaaattagaaatgactggactgttaatatttacattgtgctcagctggtttataaaagtacactaacttcctcctatgtccaccccaatctcttacatcaaaatttccagggtcagggcttgggaacttgtattttaaaaaatgatccccaggactttctgggtgttgggaatgttctcatattttaatctatggttgttacatagtgtgtatgtgttaaaatccctcaggatgtacatttaagttctatacacatcattctaatattgcattctctcaaatgttacaccctaattttaaaagttcctccaaa

SEQ ID NO: 60877 - DNA, 2848 bp, Homo sapiens
aatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattgttcacaattttggtatgaaccatgatggaattggaaattcttgtggacgaaaggtcatgaagcagcaaaattatggcagctcacattactgcgaataccaatcctttttcctggtctgcttgcagtcgagactacatcaccagctttttagagaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggagggggcggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtaagatgcccactaggcagcccacccagagggcaagatggagaacaaaacacattctgagctatgctttgtgtttgttaaaaaagctaattggaaacatttcttgcaggtttgcttcaagctgtaatttagcaaaagaaactttgctttaattatattatattccatttgttttcaacctcatgtaatttgtgcagatttgttggtaaaatacatcttggcacaatgagtgtctctgctggtgcttctcccaagactatcttgaaggtgggctgtttgcctttcgtgaacacattcttggtaaagaacatcaaaagttttaaaaaagaaaatgagcaagaatcagacatcacagatgcaacttcttgtaatgggagatgagaatgtacggctgtg

SEQ ID NO: 60878 - DNA, 1859 bp, Homo sapiens
ctagaggatccccccaccggcaggttgtactcctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattgttcacaattttggtatgaaccatgatggaattggaaattcttgtggacgaaaggtcatgaagcagcaaaattatggcagctcacattactgcgaataccaatcctttttcctggtctgcttgcagtcgagactacatcaccagctttttagagaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatcagattataaggagatacagttaacataactatattatggatacatatatatttatgttttcttcattaatattgactctactagctcagaacttgaggcaattctgctgtcatactaaaatgtattttcatgctatccaagttaataaagttgtctgaatgtaatt

SEQ ID NO: 60879 - DNA, 456 bp, Homo sapiens
gccatttttattcttttcggcactatttactttaagaaaatgtagtatttttaacactactattccttggggatgaagaaaaacaaaatgtttaaagctagttcaagggtctttttaatgtattttaaatttttgaatagattatacattacatagttaaaatattcaaagaatataaaggatgtgtatgaaaagttaacctttctccatcctctgcccctcattttcccgtttctagttgccctttacagagataaccatgattactcatttcttatgtatcctttccgagacaaacatatgctcgtatacatatagtatttacgttcatctctccccctttacacaaatagtattatggcatattacacactgtctgtatgttcttttcctcacatagctatgtatcttggaaaatgttccaaatgagtatgtatagaaatagctgcattttat

SEQ ID NO: 60880 - DNA, 421 bp, Homo sapiens
gatttccaatcagagacggtcaagttggcaagtgtccccctcttgctcattttttccctgttagctccattgacaacataggccgtatccaaaccacctttgttcagtgctttggctgtaatcacctctccggtttccaggcctcttctctttaggcttttcaggctgctcactagccaaaccaacagaatgtgctgaagagaaggagaaagaggaagaagagaaagcaagccaaggacctcttttgcaaattgatgatggcttgaaatcaatttatttggaaaaatagtcagactacagaaaaaaacatccttgcaacattttcaatccaaaaaagatggcagtatcattccttcaaagttcagcaaatatttgataagtacaacaataattataataaatttcatgaccctacttggta

SEQ ID NO: 60881 - DNA, 382 bp, Homo sapiens
agaaacacatccgacttccagagcacccagacaatgacccactcaagcctttagaagacacgaaggtatgacgtatttatttttaaatgttggctataaatgatcagactgcctacttgactagggtggtcttcccagctcaatttccacagagaatgctgaagtgtgagttaggtataacaaggggacattttctgaagcgtggatcaagaagaatttaagtggtgtaaagttgttttccttcaggggctatgtcacactggacagtactgttagactatacacctggatggaatccatgagagaaggaaacttgccttaggtgaccataggattcagccagttattaaccaaactttttcagttagtgtattcagactcc

SEQ ID NO: 60882 - DNA, 476 bp, Homo sapiens
gtttctttttgcctttttaatgtagccactagaaaatttaaaatttcacacatgactcatactatatttctgttgtacagcactatgctaaagaatgaacagcagttttctagacttgcttactactggtagatacataggtcacaataggctcatcacttccctttggagggagctatggattggtgtgattaagagaacaggctgtttaggttcaaatcctgaagccaccatgcctgtcattaggtaagtttcctttctaaacctcagcttcctcacccacaaaataagaatattggtatcagggccgggaaaggtggctcacgcctgtaatcccagaactttgagaggtgggagtgggcggatcacctgaggtctggagttcgagtccagcctgaccaacatggagaaatcccgtctctactaaaaatacaaaattagccggatatggtggcacatgcctgtaatcccagcta

SEQ ID NO: 60883 - DNA, 103 bp, Homo sapiens
agatcttatttctataggcaagatcagacttactaagtatgccacaactaacagctgattcattcattctatgtgtgccactaaataaagagattgagcaagt

SEQ ID NO: 60884 - DNA, 495 bp, Homo sapiens
ggaagcatgagcaggagggttccgaggaggatatcttgcagctcttactatcgagatgcaggtggtaactcctttttatcccaagccccagagccacccacatgtttcacttcctttaaaagagatcctaaaattgtttgcttctccactctggtctcttaccactgcttttttctgttgtagggagaagagagtgaagggagaatgttccttttatgcctcgcccctttaaactgcataattgtgtcagtaactgggtttcctgtacaactgtgccccatgttccaaggccagaaagtagaatagcacagatgttacccaaaagctgagttgggtaacagtcagaaaccaatagctaaccaggaataaagccatacaagagagcaggactgtgctgttactcagcccactttttctagataagatctcacacatgcaaagtagggcacttgcctacatttaataattcttccattaataaatgggaaggttcta

SEQ ID NO: 60885 - DNA, 534 bp, Homo sapiens
aagtatcaaaacacatggaccctttatagagattaaagggctttggattaaaaggtttgaagtagttgaaacctttacagaaacaaaagcaacatgtcattactttcccattaaaaatttcaaatgaacaccctcagttaatgctttgctgccatatctttttttccctttggaaatccaaaagcctgtgaatctggtccatgtcaattattttgtttacaggatattgcattactaaacccaaggtgatctccaagttggagaaaggagaagagccatggtctttagaagatgaattcctgaaccagaggtacccaggtgagtgggcattaacagaaggagccccctgggggtacttagtctttagagggagagcacctttgaaagtttttttggaacagctttattgagatataattcacatgcctacaattcactcctttaaagtgtacaggtcagtgacttcaagcaaccacagatcaaaactattcagggaagaaatattgcactttcattcaacatgtatagacattt

SEQ ID NO: 60886 - DNA, 655 bp, Homo sapiens
ctcgaccaggaagtccagctggcttcacctctcaggcacatgaataggattacatgctccttgattacagtggggttatgtcgcagtaaaaccattatcaagtcgaaccatctcatgtcagggaccatctctgtaagaactgagaggcagaccaggtctctcatgaccccactgctctttcctcctccccagctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacccaaggtgatctccaagttggagaaaggagaagagccatggtctttagaagatgaattcctgaaccagaggtacccagggtattttaaagttgatcacatcaaagggatccgggaaaaacaagaaaaacttctgtggcaagaaatattcatcagtgatgctgacaaaacattgagtaaagaaggacagaaagttttagaaaaaccatttaatctggaaatagctccagagctttcagaaaaaatatcctgtaaatgtga

SEQ ID NO: 60887 - DNA, 2782 bp, Homo sapiens
ggcccggctgtggtcgctgcgtgtgaggcccctggagccaggcagccctttacagaccctatccaacttccagacctgccgagccagctcccagctccttccctcatgcgtgtgcgcttactgggtgctaggcactgtgtttagcaccatgctcagacggggagcgtcgcaggccttccttgcctagtggtggaaggaaatgttaaccatagggttgcagggaaacgtagcgttgctgcggacacgggctcagcaaggcctctgcaagtgtgcggtgagagcccctctggggttcagggaagtcttcccagggaaatgatgctggcctgggtaactatggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcaga

SEQ ID NO: 60888 - DNA, 2693 bp, Homo sapiens
aaagaatttctcaggctcaaaatccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcagaaaacagatcttgattttttttctcttgaatgtacccttcaactgttgaatgtttaatagtaaatcttatatgtccttatttactttttagctttctctcaaataaagtgtaacactagttgagata

SEQ ID NO: 60889 - DNA, 2404 bp, Homo sapiens
aaagaatttctcaggctcaaaatccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaaccttacacgggagcccgagctcga

SEQ ID NO: 60890 - DNA, 1494 bp, Homo sapiens
cgacaatcgaggggttactagaagattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcaga

SEQ ID NO: 60891 - DNA, 1238 bp, Homo sapiens
aaagaatttctcaggctcaaaatccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagcgtttcctgtctttgtactttcttcatttccaccttgcccagtcatactgctttttcatggaccaccagtgttgcggaatcctcgg

SEQ ID NO: 60892 - DNA, 2567 bp, Homo sapiens
aaagaatttctcaggctcaaaatccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcaga

SEQ ID NO: 60893 - DNA, 2039 bp, Homo sapiens
aaagaatttctcaggctcaaaatccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattcctttagagtgtcgcgcgacactcttggttgcaattttgttgtctgcatcccaatgggaggaaaaagtagtaagccatcatcttattttgtctagaggtaactttccaactttgctcttggtttcatgcctaaccttctgtgtgcagaataataaagaaaaaagctaagattcttaaatatcctgataaaggcatcaaatt

SEQ ID NO: 60894 - DNA, 695 bp, Homo sapiens
cgggctggctctcggtgtgtgcccttcggatggtcggctgaagagggccgccagctggacttctgtagacaagacagatactgtaaagacagcaaagaacaaacagaatggcagattgctaatgtttgatccaaacgaaaaagtgatgattgaatcaaacgaagcaatgtcagagtaagaagatgtctttgattgtgcagctgatctctcccatgccttttaagcaattagaactagataatgcagccatttgtcacccaattaaatttgaaaggccagaaatgcatggattagcacttcagcttttgctgcagtcaaagcaattgttacttagatagaaggacagttaaaatgaaaaatgaattttgataaaaatgcagaagtatagataatattcacttctactttttaatgcttaaacaccctgtattctgtattttacttgtatcataattttcattgctcattcctatttccctttgatacttatttctttcacaatatttcttcaagtgaatatgtactttaaaattaacaaattatttactataacatgaattgttactactcaataaagaaagtaatcacctcaactagttgaagaaactggtgttaaaaaaattgtattctttccagccttttggctaagatcaagtgtaaaaaaatcacagtacaatatcaatttagtagctaaa

SEQ ID NO: 60895 - DNA, 678 bp, Homo sapiens
  misc_feature (29)..(29): n is a, c, g, or t
  misc_feature (57)..(57): n is a, c, g, or t
cctcgctccccgctctcaaaaaacaacanaacgctccaggcactcctgtgagacagnatgatactgtaaacacagcaaagaacaaacagaatggcagattgctaatgtttgatccaaacgaaaaagtgatgattgaatcaaacgaagcaatgtcagagtaagaagatgtctttgattgtgcagctgatctctcccatgccttttaagcaattagaactagataatgcagccatttgtcacccaattaaatttgaaaggccagaaatgcatggattagcacttcagcttttgctgcagtcaaagcaattgttacttagatagaaggacagttaaaatgaaaaatgaattttgataaaaatgcagaagtatagataatattcacttctactttttaatgcttaaacaccctgtattctgtattttacttgtatcataattttcattgctcattcctatttccctttgatacttatttctttcacaatatttcttcaagtgaatatgtactttaaaattaacaaattatttactataacatgaattgttactactcaataaagaaagtaatcacctcaactagttgaagaaactggtgttaaaaaaattgtattctttccagccttttggctaagatcaagtgtaaaaaaatcacagtacaatatcaatttagtagctaaa

SEQ ID NO: 60896 - DNA, 735 bp, Homo sapiens
gcagtctccacggcgacgctgcgttcccgactcggagcccccagctccgcgcgagcagctagccgggctggctctcggtgtgtgcccttcggatggtcggctgaagagggccgccagctggtaagacactccgaggcaacgaccggtctccctctccctagcccggtgtgcagtctgacccagcccccacagcagaccacccccagaccgggcgcccgagtctgcggaccgctctaccgcacctggttctggctctgggccccgggccccgtggctgccaggggccgccgggaagggaggatgcgcgccactggggtgcgcctggcttgcggcaccctcctcccgcagtggtcggaagaggtgaggaagcgccgttcgtgtctacacgggtgtggagataactgggcgattctgacaggcttgtctacactaccattctttgaccggccggtgcacacgcaccaactccttccccgcaaataacgaagatggcccagcccatcccagggcttcccgacccccttccctcagtccttgcccttgcccggaattcttttacttatttttggaaaattagttaagacatcactactagctagatataacttgctagccatacaaatttcgatggaatttggacaaatcatttatattcccgggccttattctcatcttatgagatgatgaaattgacttgaaacttccaaaatgttgatattgttcttttgactactc

SEQ ID NO: 60897 - DNA, 1044 bp, Homo sapiens
tgtgattggtggtagtgacacaaatctgcacctgtgataaagcgatacatagctatacacacacactgtactaatgtcagtttcctagttttgattttatattatagtaagatgtaaccatgggagaaactgggtgcagggtacaggggacctcttttgctatctttggaacttcctttgaatctaaaattatttcaaaattaaaaaaaaatttttttaaattatcctagctaaagcatcaagtgaaagttcttaagagaaaaaaagaaaacaagggaagggaaggtacaggatgtctgggaaattgtctgtgacatttaaactggtttttgcccagggggcatttgccaaatctggtttcctttcctcagcatcagagagcattgaggaacctgaggaaataataaggtctttctttctgggatgatgaatctgatacgttcttcctcttcaccttaaagctgagactcagctaaactggaaaccaccaccaatcccaccatccttcaagattgcagggaaagttgattttctgcatgcttcttagtttttaatgtgcatcagaatcacatggaggtcttgttaaaacaaagattgctgggcaacatccccagagtgtaagattcagtaggtctggggtgagacttttaaaatttgtacctctaataagtttccagatgatagtgattttgctggtcgggaaccacactgcaaaaattatttgtatagctaaaaccttgtcggagtgaatatgggggcaagatcactgctgagaattttaagcaaccagctgacccttgtataatttgcagtgcgaatttaacgctgtgtaggtgatctaaaaaaaaaaaagaaaaagaattccctaagataatttatccccataatggcagtatacatagactggcagtgagtatccccagactcttgtagaagctaacagaaattctctttggagaaactcatctccatcccagagttgaaagttttcctagaaataaaattctaagtaagtagaacaactgtgatagtcaaaaagaaaaa

SEQ ID NO: 60898 - DNA, 228 bp, Homo sapiens
ttgtactcatgggacatgctgatgtatacacaggtacatgtttgggctgaagataaaggtttgggaacacatggcccactggaagtacgtaaagccagagtggggccggaggctgattagatggtctgggtcagaagagaagaaggcatgggaaaaccacatctatagggcaagcaggggaaagcccacagcagaaaagaggaaaaaagaatgctcagagcaggggga

SEQ ID NO: 60899 - DNA, 403 bp, Homo sapiens
cttgagcacttacattaatgggagaagagataaagagggaaacacggggagtgtgggatgtgtgagactgcatgttcacagggaaaagtaatgttgtgcagaaagcctgccactgctaatgaacctggtaagaggacaggaaggaaagggattatttctgttatcccttttgggaaacaattttccatgtgtcttacatttttacatctggcaggtgctgacagtccttgtgctgggctctctttttaaggatgtttccatagtggaaacatatatggaaaaacggagctgggctggagcatagggcaggtgcacttagggtccattatgcaaaatttgggttttctatactcagggcttctctctcataagccaccccacagtgtgtgcaggtattgcctgg

SEQ ID NO: 60900 - DNA, 468 bp, Homo sapiens
gtgattagttggtgtacttcagcaggagcaaccagatgaattggcttctctatatccccgtattagccacaagctaggcagcagcctgcaggtgggagcaatgcctatgcatgtatggatcagtgtgctacatacagtcacgttgacagcatgaaccttcgatgtgatgtgaggaaaatggcattctacctctgtgttcttcctccccaaaatttgtaaccaccatctaatcatgaggaaaacatcatacaagtccaaattgaggaagattctacaaaatgcctgattaatattcatcgaaactgtcaaggtcatcaaaagcaaggaaagtctgagaaactgccacagcctaaagacaatccagggaaacgtgatgactcagtggtattcggggtgggtttctggaacagcaaaaggacaacaggtaaaatctaagaacatacgaataaagtgtgaactttaattaat

SEQ ID NO: 60901 - DNA, 1108 bp, Homo sapiens
gtgattagttggtgtacttcagcaggagcaaccagatgaattggcttctctatatccccgtattagccacaagctaggcagcagcctgcaggtgggagcaatgcctatgcatgtatggatcagtgtgctacatacagtcacgttgacagcatgaaccttcgatgtgatgtgaggaaaatggcattctacctctgtgttcttcctccccaaaatttgtaaccaccatctaatcatgaggaaaacatcatacaagtccaaattgaggaagattctacaaaatgcctgattaatattcatcgaaactgtcaaggtcatcaaaagcaaggaaagtctgagaaactgccacagcctaaagacaatccagggaaacgtgatgactcagtggtattcggggtgggtttctggaacagcaaaaggacaacagtgttaacatctgggccaaacatctgggcagcaacatcagaaagcccctctgctgtgcttcaggatcactcttatcactgcataaaggtaccctgagccactatctaaattgtctgcttaccttatgaagacaccataaggaggtataacgtgtggtgagcacaggtgaagagctagaggcctgaaactagatggggagggagaagccagccatgcctgcatccagggctgcactcagcctcccagcatctgtgcagaggcatcagtcaagccacagctaactgcagtcccagctaacattatgtggaacatcccagtcatcccagatcatcccagtcaaccaagatcataaaattgttttcagctattaagtttaaatacgtgaaataaggagataaaaatactgacttggactctgtctgaatgaaaggattagtagattagattagtgattcttaaaagactttcttggatgcatataagtgtccacaaaataagagtatgatggtttccaggtacaaataagatggaaaactattttgtgaatcagaattaaattggtttatttactgtagaacttctaagaggctttaacatgtacatttaattatcataagccttatgaaaactccaggaggacagaagagttgcctgtgactttttttaaagtgtttattcacatccc

SEQ ID NO: 60902 - DNA, 1103 bp, Homo sapiens
ttccttgcccggactacgctgactcatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 60903 - DNA, 1255 bp, Homo sapiens
gagattacgggtgcgagccactgcgcccggccacattttatagccaaccggcttcttgtgtaacaagagatgctactattctgcccactatacaccagcactcagttgagacatatgaccgactgggaccgacatcaacagtccatgggacgatattctgagcggacatatggggagggctagtggagggtggctgtgacttggggactggggaggacagatgctgggagcagctgcaggaaaaccagtgaggacttaacccctaccggtctgctcccagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 60904 - DNA, 915 bp, Homo sapiens
gccacccatggatgtcacttggcagcaagcaccgaaatcttctttagtggagtgctttgtatgcctctgtcctagctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 60905 - DNA, 1206 bp, Homo sapiens
  misc_feature (58)..(58): n is a, c, g, or t
  misc_feature (61)..(64): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (81)..(81): n is a, c, g, or t
  misc_feature (83)..(84): n is a, c, g, or t
agcggaaccaggaggtatcgctgcccgccgccaccggccgcccgcccgcccggctccnccnnnngnctcngctgcgcngcncnncgcgccggcacgagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttccttccatctcttttatcagggttgggggtcacagttcttgtaccaaagcccaaatcccatatgcagacgtttggtcttataagga

SEQ ID NO: 60906 - DNA, 887 bp, Homo sapiens
caacataggctagtacaggccgggtgtgaattggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 60907 - DNA, 332 bp, Homo sapiens
ttggggggagggctggtggccagcctcccggctgttgggtgagcttttctcccttcagtcttagagcatcccctttctctctctccctcactgtcccccctgttcttctcctgagcacagatcctcatgatccggtacccgagcagtcagctgggggagatgtccctggaagaacacagccagtgtgaatgcaggtgccagccaggcccaacttctgagctcgcagaggccaggcttggggggtgctgggtatggtggtccacagaactggggaccaggttcctaagagtagaaccaaggggccgggcgtggtagctcacgcctgtaatccc

SEQ ID NO: 60908 - DNA, 1217 bp, Homo sapiens
  misc_feature (58)..(58): n is a, c, g, or t
  misc_feature (61)..(64): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (81)..(81): n is a, c, g, or t
  misc_feature (83)..(84): n is a, c, g, or t
agcggaaccaggaggtatcgctgcccgccgccaccggccgcccgcccgcccggctccnccnnnngnctcngctgcgcngcncnncgcgccggcacgagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 60909 - DNA, 1116 bp, Homo sapiens
  misc_feature (58)..(58): n is a, c, g, or t
  misc_feature (61)..(64): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (81)..(81): n is a, c, g, or t
  misc_feature (83)..(84): n is a, c, g, or t
agcggaaccaggaggtatcgctgcccgccgccaccggccgcccgcccgcccggctccnccnnnngnctcngctgcgcngcncnncgcgccggcacgagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 60910 - DNA, 1706 bp, Homo sapiens
  misc_feature (58)..(58): n is a, c, g, or t
  misc_feature (61)..(64): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (81)..(81): n is a, c, g, or t
  misc_feature (83)..(84): n is a, c, g, or t
agcggaaccaggaggtatcgctgcccgccgccaccggccgcccgcccgcccggctccnccnnnngnctcngctgcgcngcncnncgcgccggcacgagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgcccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggagagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggcagcgctttcagca

SEQ ID NO: 60911 - DNA, 1162 bp, Homo sapiens
  misc_feature (58)..(58): n is a, c, g, or t
  misc_feature (61)..(64): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (81)..(81): n is a, c, g, or t
  misc_feature (83)..(84): n is a, c, g, or t
agcggaaccaggaggtatcgctgcccgccgccaccggccgcccgcccgcccggctccnccnnnngnctcngctgcgcngcncnncgcgccggcacgagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgccggaagctgcgaaggtgacacatggcttttcagactcagcagggtgacttgcctcagaggctatatcccagtgggggaacaaagaggagcctgctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaagga

SEQ ID NO: 60912 - DNA, 890 bp, Homo sapiens
  misc_feature (58)..(58): n is a, c, g, or t
  misc_feature (61)..(64): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (81)..(81): n is a, c, g, or t
  misc_feature (83)..(84): n is a, c, g, or t
agcggaaccaggaggtatcgctgcccgccgccaccggccgcccgcccgcccggctccnccnnnngnctcngctgcgcngcncnncgcgccggcacgagggcgatgcgggcgcccccggcgggcggccccggcgggcaccatgagccctctgctccgccgcctgctgctcgccgcactcctgcagctggcccccgcccaggcccctgtctcccagcctgatgcccctggccaccagaggaaagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcagatcctcatgatccggtacccgagcagtcagctgggggagatgtccctggaagaacacagccagtgtgaatgcagacctaaaaaaaaggacagtgctgtgaagccagacagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcagctgctggcacctggagctgtataagcaagtccaacattctaactcaggagtcagatacaggagggacaatgccagcagaggatgtcaagggctgtggtgaggggt

SEQ ID NO: 60913 - DNA, 3560 bp, Homo sapiens
tattgaggcactggcccagggaactgagccttgggcctgtcctaaagctccataggtgactgcactgcagcccacatggagagctgcagctctaacacagggattttgagaggcctcagtgccatttaagtggcacttccaggacacccatcctgagctcccacaaagggcgccaccttcccaagaacgtctaattgtcattggaacagccagtgtcaggcagcttctgctcaggctgatgtggcgtctgacccttggtgggttgccagacattccttcctgtttctgccatgggaagttggcactgggaatggtatggagcccccacttctaccctgagccttgggtgtctgctgcttccaggtgaaaaatggacatttctgatactgcccagccactacggcaccacaacccatgctcatagtctccagggatgtgtagaacggcaatggcaggacagcaaacaactggcgatttccccaggtcccacgctcttgcggagtgagtatgttgggtccctgtccccagtgtgttccagccttacccaggtgcacagagtaccctggggccagcacagggcttgtccagtgatgctcctggtgttcacaaaatggctccagagatacctgcattttgaaaagcctgccgagccagcaagtgtagggcaggacccggatttctttggcaaatctgaaggtgagagggccacttgcctgctgagtagaagctgcctttacctggccagtgtatgcaacttgagagaaaatgacagctgcatggggcgctctggtgggactgggaagtctgatcttccggggagctgtagatagtgaatttcaagttgacagctaccttctcagggatttatatataaatatagttagaggaaaagctaaaatctattttactagtttttagtgtttgtgtaaagtaagcttaaactggacagaataaacatttctcagacaatgttgatgctactgattacaagttagatggctggagcttgccccttggtggagaatttctcggtgattggagactggggactctggcagcagaagtggctttatggtgggtgtgaagttgcttctgcccctctgagtggcctctcatggatgtgaatgcgtgtattgacaccagtgaaatccacctccgtgtgcgtggaggtggctgatgagaacacaagtgagccagtcctggttcttccctccagaaccggtcactcccagtctgacgttggagcatgtgaactaagagtgacatttttttctacttgcttctgtgaataaagtgttctacagtcagccagcactaaacaccagaaaggaggagggaacagcgtggagcaattcatctggaattacctcggtgtgcagaggctgtcccttggctccacttgggataaacattgtgaaacatcgtgggcctctttcttctcaagctcctcctgacagcctcctggcaacactagaggcctcaagactatggagatcagaattgcaatggctttgtcatctcagcattgaccactcctgagacccaaggttcctcctgggagcaggagacaaggagtttgtgatgttggatggaaaataggatatatgaatgcagaagggctgtgctggacccctcttttcgcttctctccctgctgtcagcagtgtctctggcatggaggcgaatctgttgtgggtgaaacagaagcccctggggtaggaccagaccccaggcctgaaaaggatgcaaagcctgctgtttcaggctgtcaggaagaatcgtgggtaccgagtgattatgatgaaatgcaacccagagaggaaatgaatgggccctcactaagaagtgggtctgacatgtctctggcagcccaccggcaagagcacgacatgccctgcagccccaccatccacactacatgatgtgggagggctgtctgttcattcttacactggggacccaagcctgctctgaggagtgagtcacagccctgacgtgcgccttgcattactgtttcctgagatgtgcccggagactcaagcttgctcatttctgtcctgacacagctcactgttccttaggtggtcatagtcctcccgtgctgtgtcagctcctacatagcattagtctttcacgtgataaagtgcaagcacttttccattttacagtatttggggaaattctaacacactccccagggatttgtgcatgtccttctgcctccccggtgggtcattctgtggattccgcacctggcagtcggtcttcccccttggaagcccctaggatccctgtttctacgggcctggtccttggtttctaccccagtcccttttggccggcacctgcctggaactgcctggagcgccatggtatggggaaggacaggtggaaccctgaccacaacagatccttctaaaacaacagtcacattgatgatgatgagtgcagtggggtgaatgtcgtcacagcatgcatgctgggagctgccaagggcttacaacaaaagcagttcttcctaaggcaccctttgcatcttcccatccacgcctctcagtgcatttggaacttgcttatgcattggaataacttgagtcagctgctcgtttctgtgcctctgcactcacaggttccttcattaacattttaaataagtggttaaaaactcctctggaggttgtttttgaaagaaacagggaaaagaaaaacacacactacctgaattgatttgagtaattttccagtgactcagttgaaactcagtgttgcatacataatttcctcatgctgagccagcctgaaataagacttgataagaggcacagccctaagtagcaggcagtgccactgtggacagtgtacactatggtgtgagtgtgtgcacaggcgagcctaagtgtgtgtactcatacacacagataaaccgaaaggacactgggctttgtgctggcaaaggctgtgatgctgctgtggctttctatgggccctggggagtgtcagatgggaagtgctttgatggcatgttgttcagtgtatttaatggggtctcccatggcccgaggacccactgtgagcactccacccactgtggcgcagaacacggctggagtcatcatagcccaggtctttattgaaagggagtgttgacccagaagcctcatatagaaaccatttggcaaggtctggaccatctctctgcaactgacctgccttggccgcacagagggacccaaacccaaaaggcccagacccaagggagactgaatcacatttaccattacaccagctttcatttatttgtttccatatgatcatagggactgtattactaagtatgcttataaatgctatttacagactgttcccttttataaggtgaaagattaataaagaacaaaaaattgcctgtagaaaaccatgcctgaggccaggagcagtggctcatgcccgtaatcccagcactttgggagaccaagacaagcagatcacccaaggtcaggagttcaagaccagcctggccaacttggagaaaccccagctctacaaaaatacaaaaaaaaa

SEQ ID NO: 60914 - DNA, 447 bp, Homo sapiens
gaagcaacagaaggtaaacatttgcctacatctcagaatgagttcattgtggatttgacccaggaactcaaggtcctgattcccagcatggagatctgtccctgagccagaaagctctgttcttcctaggcttgcatacagtgatggtgagagatctcacgggcaaacggggcacaccttttgcacccctcctccctaggccgctccttatcagacaggtttgaggggaagttcccaaactgccagagagaatcagcacttcccagtcaggctttgttccctcctggctgtggtcatccgtttggggtaaccccaaagaataaatgctggagaggtttatttcccccaacaatccaaagagcaggggccccaccctagagctctctattgtcaggtgggtgtggcagggcactcaggtagtagagatgatggtggcctcctccttgg

SEQ ID NO: 60915 - DNA, 1346 bp, Homo sapiens
taaaacaagcaaattttattaaaggaaaattttgcaggtttaaggtttgcaggtgaaattttgtaggtgaaaaggtttacttttcaccagtctgttctggcatgcttctaatgatgtcagagtcacctggatcaatgatagccagtgtgcacactctgtagtattttccgcatgctgtgcccagttcaatattattgccactcaaagctgggcagttgttagcgagaatgaccaatttcgctttgccttgtctgatcatcttcagagtctgcttgtaccccaggacgtacttcccacttttcataacgagttggagcctagagttgatcgactccagcgactttttcgtcttctttgcggcagccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60916 - DNA, 1436 bp, Homo sapiens
cccgcgcctgcgcgctggccgcctcgtgcgtcactcggctcttgccggctgccggacccttccccaccggcgacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcaccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggacacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaacagaaacacaacacaaaaacagcaaaactacacaaaacacaaaaagcaaaacacacaaaacaagggcagcaaaacaccgagcccagaaaagaacccacatataaagacgcaccagccgacgaaaaagacgacacaaaaacaagaaaagaagcagaagacgccgcgcgcagccacaacacgagcaacaacaaaacccggaccacacagcgacacacgcaaataaaagacgagacaaaaaacaccccaccccaccacccagcagcccc

SEQ ID NO: 60917 - DNA, 350 bp, Homo sapiens
  misc_feature (35)..(35): n is a, c, g, or t
agcggcccctactactactaaattcgcggccgctncgtgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60918 - DNA, 586 bp, Homo sapiens
caggccgcgttcgcccgccaggccccggcgtttttcggtgatcagttcgaccggcgacgcgcctgctccagcaattggatatctggatagggtggtcgggcagtctctgaagggggcggggatgctgttgctaagaagtagtactttcagaggctttaagtggaaggaagaaggcaaagggggcggagtgggttggggacctgatgagacgtcaggattggtttccagaatgaaggaccgcctggcagcagaagaactgtgtagctaaacttggggttgtccctgcccgacagggcggggtgcttcttaagttgacactgcctgcggctcacctcccagggaggcaggccaggccatctcacctgagcagcctccttctacagctccgcccaccccgtcatctggaccccatgagccttaagcagctggctcgcaggcagttggttacttccggagcccgtgtgtgcccagccccgttctgggggtgggggatgcagctgaggggctgggcaggtgtggaaggagcccccgagcgaccgtaacggcacgtggatactcaagagtctacctacagatgcagactact

SEQ ID NO: 60919 - DNA, 953 bp, Homo sapiens
  misc_feature (909)..(909): n is a, c, g, or t
  misc_feature (911)..(911): n is a, c, g, or t
  misc_feature (923)..(923): n is a, c, g, or t
taggctagtagaggcgggtggtgtgtcctggtcgcgcgtcttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccactcattcgcgtttacagattgagcggtgtntntttgccgtgggnccgcccaaaagatggcgcgaaaaaacataa

SEQ ID NO: 60920 - DNA, 154 bp, Homo sapiens
ctatacgggggcggagtttacgggagaagggggcgcagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60921 - DNA, 469 bp, Homo sapiens
cggacgcgtgggtcgacccacgcgtccgcttacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60922 - DNA, 415 bp, Homo sapiens
actctagagggatgccccgttgggccaacgcaccgtacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcgttggcccaacacgtgcgttgctcaacgggccgagctcga

SEQ ID NO: 60923 - DNA, 476 bp, Homo sapiens
tagctagtgaggctggttgaatcggccgaggcccgcgtcgcgttattctcctccttggtcgcgcgtcttggctggcgtcagaaaaatggctacaaacttcctagcacatgagaagatctggttcgacaagttcaaatatgacgacgcagaaaggagattctactgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60924 - DNA, 1026 bp, Homo sapiens
  misc_feature (8)..(8): n is a, c, g, or t
  misc_feature (19)..(19): n is a, c, g, or t
  misc_feature (896)..(896): n is a, c, g, or t
  misc_feature (905)..(905): n is a, c, g, or t
  misc_feature (911)..(911): n is a, c, g, or t
  misc_feature (932)..(933): n is a, c, g, or t
cccgcaanaaagtacttanggctaggtagcgaggctgggtggcgggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcaccgtgggccgactgntgggggggntcccanttggggcctgcgtgtgtttcnntttcaagttgaagcgatttgtgttccctgtggcgcctagaggcggaaaaaaaaaactcccttggggcggcgggggttttgcctgggaggcgtt

SEQ ID NO: 60925 - DNA, 976 bp, Homo sapiens
  misc_feature (820)..(820): n is a, c, g, or t
  misc_feature (826)..(827): n is a, c, g, or t
  misc_feature (837)..(837): n is a, c, g, or t
  misc_feature (847)..(848): n is a, c, g, or t
  misc_feature (852)..(852): n is a, c, g, or t
  misc_feature (858)..(858): n is a, c, g, or t
  misc_feature (861)..(861): n is a, c, g, or t
tggctaggtcgaggctggggtgttgattcctcctcctggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccaccnagtgtnnatatcgcagnttaaagattnnagcngaggtntgncggccggtgtaggccgccgattagatggaccggcaaaaaaagacaaaaaaaccggtctttgggggaaggaaaacgacgtagccagttgaaggaggggccaggaatatggcacagc

SEQ ID NO: 60926 - DNA, 998 bp, Homo sapiens
  misc_feature (829)..(829): n is a, c, g, or t
  misc_feature (831)..(831): n is a, c, g, or t
  misc_feature (835)..(835): n is a, c, g, or t
ccccacttaggctaggtaggaggcgggggtgaatcggccgagggcgatcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcactcccngntggngcctgcgtggcattcgcagttcacagatctgaacgtgttttagttgccttgtagccgccgataaaagggaggaaaaaaaaaaacggtttggggcagaaagcgagcgtccccctcgaagaacgccatgtttaccgtctgatagggttcccagaaaacaacaccc

SEQ ID NO: 60927 - DNA, 590 bp, Homo sapiens
gtatgacatgattaccaattttactcggtaccttgcctctggcggtaccccccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60928 - DNA, 937 bp, Homo sapiens
  misc_feature (262)..(263): n is a, c, g, or t
  misc_feature (266)..(266): n is a, c, g, or t
tcctgtaaggctgaatctcatcattctttaagaagagtgcgtgagaaagaaaaaatctgcttgtatgggacagaggcccactgcaagatactcctcttctcttacagatacgtcgagttcttcttttccatttttctttcaccctcatctctactggtcagttccatatcagcatcctccactgtctttttctcaccattctggaagtactgctgaagggcagtgtacagtttaaacacttggctgaaagaaagcttactgnnggncaagatcatgtgacgcagaacgcgcctaattaggcgcgttctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60929 - DNA, 465 bp, Homo sapiens
ggtgttccagcagctgtttttggagaagacaaagaaaattaaagttttccctgaataaatgcattattatgaggttgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacacctctagaagcctgccacaaccgggatcctctagacagccagcc

SEQ ID NO: 60930 - DNA, 2771 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60931 - DNA, 1503 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60932 - DNA, 3179 bp, Homo sapiens
  misc_feature (3067)..(3067): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaaaaaaaaaaaaaggggggggggggtaaaaaatatacccccgggggggccccaattacgggaaacccccccgttttcggggcaccagaggggcggccctacatggggggaggggcgaatttaataaagcaaggggacagcggggcggggcgttattaaacaacggttttgtggtagcggggggaacaacccggtctagctgggggatcttgggggaggagggaaaccccttattctgggggggggcgacatattggggagaacactacctctacggagagatattanaaggaccgagggggaactattaacactttcaggcgtgtatagtgtgtgttaccacgacgtcatatgctggcgggagaaaattggccacgggagattattgtgaaacttatca

SEQ ID NO: 60933 - DNA, 3191 bp, Homo sapiens
  misc_feature (3191)..(3191): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaacagagacaacgaaacagagaccaaaaagcaaacaggagggagacaaaaaggacgggaggagaaacacagaacgatacaaaggcgcgcaagtgacaaacagtgcggcagcaagcgcgagacaaagagggaaacagcgggaccaacaagcggcaccaaaccgcaacggcgagagcaggataagcaagaacgcagaagcgaacgaggagcgggagaagaagccgacgcagacgagaaaccgagcagcacaacgggggaagaacaaccgagaggacgagcacgagcgcagaaagcagaacaaagacctcacaaagccgaaccagacgaagagaggaagaaagaagcgaggacaggagagccacgcagaggccagggagacagggagcaagagacggaggcacccgcgcagacgacacn

SEQ ID NO: 60934 - DNA, 1431 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60935 - DNA, 3105 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaacacaccacacacaccaaaaaacgttgtggcggccctaggcgccccgaaaaacgttctatagaacactacctcgtgagcccagaggcccaatgtggtcacgcacacctggcgcaaaagccgtgtcaccgagaaaaaaccgcggcgccgaccaccaccacgcggcggagggactccgccaaacagcagaacaagcaaccggcggggaacacaccagagggggcaccagaaacactccacgagtgcggaccccgcgagggccacacagagggacacccaaacaccgggggccacacgcagcaccagcatacaagagtcgcccgccacgga

SEQ ID NO: 60936 - DNA, 2804 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaacaaaaaaaaataaaaaacaaaaaca

SEQ ID NO: 60937 - DNA, 2795 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaagtcgtatcgatgt

SEQ ID NO: 60938 - DNA, 2819 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcagcaaagaaccacacgccagcacaaggaaccacacgaagaaccacacg

SEQ ID NO: 60939 - DNA, 3066 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggctgaaaagaaaaaataaaatattagattaacatagatatataatatatctaagatataacgtataataatacaaaagaggagcggcgcgcaacaacgaaatgtacaccaagagtgggcggcccaaaagttagcaagcacaccgcagaacggtgtgcagaagggggggcccacatagagggaggagagagaaacagacggagaacagggggaccggagacaaaacgaccagagagagggaaaaacgaggagcggggaaccagggagaagaccacaaatactgcgggggggaaaaatg

SEQ ID NO: 60940 - DNA, 2829 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaagataacactaccaaaccaaaacacaaaggggggggcctcaaaaaaccg

SEQ ID NO: 60941 - DNA, 3017 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggctcaaaaaaaaaccttctctcttaatgtctttataaaatgtactggccgtatgtttacaattcgtcatttgtgaaaccgtggcgttcccaaataatgtcctggtcgatattccccttttgccagctggggtattaacgaaatggccggacctgatcgccttctccaacattgtccaacctcaatggctaatggctaaatgttagccgacaattttggctaaatttcgcgtatattatctttgaatcc

SEQ ID NO: 60942 - DNA, 2806 bp, Homo sapiens
  misc_feature (2772)..(2772): n is a, c, g, or t
  misc_feature (2778)..(2778): n is a, c, g, or t
  misc_feature (2780)..(2782): n is a, c, g, or t
  misc_feature (2785)..(2787): n is a, c, g, or t
  misc_feature (2790)..(2790): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcnaaaaanannnaannnacnaaaaaagtcgtatcga

SEQ ID NO: 60943 - DNA, 2972 bp, Homo sapiens
  misc_feature (2848)..(2848): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggctaaaaaaaaaaaaaaaaaaaaaaaaaaaaaaaaaaaaaaaaaaaaaaaaaaaaaaaaaaaaaaaaacaacaaaaaanaaaaaaaaaaaaaaaaaaaaacccaaaaaggtcccccaggggtaaactccaacttttgtagaggtttaaagaaacctaggaaaagggggcagcaaaggttgacatcctgaagcgtgccttgtgc

SEQ ID NO: 60944 - DNA, 3062 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaaactcaaacacagttggctgcaaagttcccactgtcccccctaggaactttgaaaaaccaacatagcatcattaatcaggaatattacagtaatgaggattttttctgtctttttttaatacacatatgcaaccaattaaacagttataatctgggcactgttaatagaaaggtgggatagtcttggctgttggcggtgaaatgcttttggtccatgtgccgttttaactgatatgcttgttagaactcagctaatggagctcaaagtatgagatacagaa

SEQ ID NO: 60945 - DNA, 2860 bp, Homo sapiens
  misc_feature (2806)..(2806): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaaaaaaaaaaaaaaacaacaaaaaanaaaaaaaaaaaaaaaaaaaaaaaaaaaaacaaaaaaaaataaaaaacaaaaaca

SEQ ID NO: 60946 - DNA, 2944 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaagcaaaagacaacaaacacagtgtgcgcacgcgtggccgccgagaacgagcaaacacacgaaggcaggggcgcccgaaaggaaggagatgtgcaaagcagcgacagaacccggacaacagcggggactcccaagaaaaccccgggggcacggagctgaaaaccag

SEQ ID NO: 60947 - DNA, 2707 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggatggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60948 - DNA, 2798 bp, Homo sapiens
  misc_feature (2287)..(2287): n is a, c, g, or t
  misc_feature (2372)..(2372): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaaatggctacaaacttnctagcacatgagaagatctggttcgacaagttcaaatatgacgacgcagaaaggagattctacgagcagatgaacgggcctgtgnaggacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60949 - DNA, 2786 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60950 - DNA, 2971 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgccgagtccgctgcattggaggggagaggagactggggaccctggcccataccctgcactccaccccacggcagtggggagcgagtcccagagtgaaccccacctcagaggaggctcctggctccgagtgggctgtaggggaacagccctgaccgtcaccctccgcctctcctcaggtgcagagtgtcgatatcgcagctttcaacaagatctgaagcctgagtgtgtgtacgtgcgcgcgtgcgtgaggccctgccacgattaaagactgagaccggc

SEQ ID NO: 60951 - DNA, 3194 bp, Homo sapiens
  misc_feature (3082)..(3082): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggcaaaaaaaaaaaaaaaaaaaaaaggggggggggggtaaaaaatatacccccgggggggccccaattacgggaaacccccccgttttcggggcaccagaggggcggccctacatggggggaggggcgaatttaataaagcaaggggacagcggggcggggcgttattaaacaacggttttgtggtagcggggggaacaacccggtctagctgggggatcttgggggaggagggaaaccccttattctgggggggggcgacatattggggagaacactacctctacggagagatattanaaggaccgagggggaactattaacactttcaggcgtgtatagtgtgtgttaccacgacgtcatatgctggcgggagaaaattggccacgggagattattgtgaaacttatca

SEQ ID NO: 60952 - DNA, 2880 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggcgccctctggctccgtcctggtcatttcctgctcgtacctggcctgtctccctccctgtctcagccccatctctgccctgctgttcccacacagt

SEQ ID NO: 60953 - DNA, 3320 bp, Homo sapiens
  misc_feature (2821)..(2821): n is a, c, g, or t
  misc_feature (3317)..(3317): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggcaaaaaaaaaaaaaaaaaaaaaaaacaacaaaaaanaaaaaaaaaaaaaaaaaaaaattatataaaaatataaatttaactatatgataaagattaaatatataatactttaatataaaaaaaaaatcttaggggggggccctgtcccaaatttgccttttagggggttgtttaaaaattaattggcggtgtttttaaacccttataattggaaaaaccttggggttcccaaacttaaatgcttttaataaaattcctttttgtctatgtgggttaatatttaaaaggtccgttccattggttttttcaaacagttgtgcacttaaaatgggaatgggcaattgttaaggttaaattttttgtaaaaatttcgtttaaatttttgtaaaataatttatttttttacacaatgggctaaattgggaaaatctctttttaataaaaaaatttctccgcaatagggtgtaggtattttccattttgtaaaaaaagtttccttttataatataatgggctttcaacgttaataggngaa

SEQ ID NO: 60954 - DNA, 1677 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggctcaaaaaaaaaccttctctcttaatgtctttataaaatgtactggccgtatgtttacaattcgtcatttgtgaaaccgtggcgttcccaaataatgtcctggtcgatattccccttttgccagctggggtattaacgaaatggccggacctgatcgccttctccaacattgtccaacctcaatggctaatggctaaatgttagccgacaattttggctaaatttcgcgtatattatctttgaatcc

SEQ ID NO: 60955 - DNA, 378 bp, Homo sapiens
cttatgttctgacccacccttatgttctgacgaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60956 - DNA, 1612 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggacacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaacagaaacacaacacaaaaacagcaaaactacacaaaacacaaaaagcaaaacacacaaaacaagggcagcaaaacaccgagcccagaaaagaacccacatataaagacgcaccagccgacgaaaaagacgacacaaaaacaagaaaagaagcagaagacgccgcgcgcagccacaacacgagcaacaacaaaacccggaccacacagcgacacacgcaaataaaagacgagacaaaaaacaccccaccccaccacccagcagcccc

SEQ ID NO: 60957 - DNA, 1393 bp, Homo sapiens
  misc_feature (1330)..(1330): n is a, c, g, or t
  misc_feature (1344)..(1344): n is a, c, g, or t
  misc_feature (1347)..(1347): n is a, c, g, or t
  misc_feature (1354)..(1354): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcaccncccgtggggccgcntgnggggggnatccccgttggggcacggcccgtgccgttcccttcaccg

SEQ ID NO: 60958 - DNA, 2526 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcctttgggatgatgagacggcggccatcgtgcgcttcgggatctctagagtcacct

SEQ ID NO: 60959 - DNA, 3161 bp, Homo sapiens
  misc_feature (2726)..(2726): n is a, c, g, or t
  misc_feature (2738)..(2738): n is a, c, g, or t
  misc_feature (2898)..(2898): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggcaaaaaaaaaaaataaaaaaaaaaaaaacgggggggantatatggggggngggggaaaaagagaggtgtattgagaatggcgacatggggtcataggcgtgtgtttccgtggacccaaggttttttgtgtgtacaacgggggtaaattcggaggggtctccatataggggaggccagtataaattgcgaataagcgcccggggttttacncgggggttgttatgaacttgttgtggagaaaaaacgggaacgataccacagacaagcagacgcccggccggcaaccaagcgcacagacaaagaagcaacgcggggggcctctcacacacgccatttgtaggctaccaacaaaacacacagcgggggtcgcctcgggaaaaaaaacacgccgtacatacgcaaatggcgagtacgacgaaacaacaagttacaccaagaccaggacgtccgacgcgaagtcacacataagagac

SEQ ID NO: 60960 - DNA, 3288 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaaggtggtgctgcgcttgtgggttccagggacactgcttgaggttacaaaattccaggctgcctggatgagggcagggaagggctcagcacagggcagaatctctgccttgcccagggtccctctttggctgggaagctccccaagtcccctgtggctgtcacatgccagggctgagaagataaggctacttataggggcgggaagcattgaagctggtttctggccctagcgctcccctgcgatgagatgtgggagccagtgtgtccctgcctgtccatcctgtgcacccccagctttccttgtcacctgaaaccacctctgagggaaggtggtggcgtctcagatgcatgggcatgtgactggtcaggtggcctccatcccagggtgccccgtctgtgtgacctccctctgggtgctgtgggcttgctccagggtgcaggtgcaaccccagcagcggtctctggggccaggcaggtgggtggacgattggacttggaggggaatacagagggcatggaagtggcgaggctggcctgttggcgagggtatcctggtggtggggcgggctgagtcagggaaggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattacctgatacccaagggttagacacacgttacaagaaaagaaaactacagataagtattctcttgaacacaggtacaaaaatgctaaatagaatttttgcaaattaaattcaatgctatataaaaacaaaacatgatctagtgggatttatttcagggatgcaaacctgtttaaggattgaaaaatcaatggatgcctcttcagattattaaagaattatttttaaagagagaaaagtccatgtaatttaccatatt

SEQ ID NO: 60961 - DNA, 1148 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccagacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60962 - DNA, 1125 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgtactgtgactgggtcaaaatttctgtctcttgatttggatagggtggtcgggcagtctctgaagggggcggggatgctgttgctaagaagtagtactttcagaggctttaagtggaaggaagaaggcaaagggggcggagtgggttggggacctgatgagacgtcaggattggtttccagaatgaaggaccgcctggcagcagaagaactgtgtagctaaacttggggttgtccctgcccgacagggcggggtgcttcttaagttgacactgcctgcggctcacctcccagggaggcaggccaggccatctcacctgagcagcctccttctacagctccgcccaccccgtcatctggaccccatgagccttaagcagctggctcgcaggcagttggttacttccggagcccgtgtgtgcccagccccgttctgggggtgggggatgcagctgaggggctgggcaggtgtggaaggagcccccgagcgaccgtaacggcacgtggatactcaagagtctacctacagatgcagactact

SEQ ID NO: 60963 - DNA, 464 bp, Homo sapiens
tagggagcgtcttcatgggccctgtggcctcccatgggccccggttcctcgttggtgccattagaacttgttgctgggactgcgggattcgggccacatgcccgcaaagaactccatgttccacttagaggcttcagagtgcagtgccaggggtgccttcccaaaagtcctccctgcctgggtggagcgtagacagctcagcaccccacggggggcgttggagccagccttggttttgttgggtaaggatgttagaagaggggcgaagacccatagccactggtgtgaagggtctgctcttgaccgaaggctgcctccctctgggtgcagaccaggcaggtggtcccagtcacggtgccctggggccactgggtctgtctgccctcaggctccactagacacacctgcggaggcagcagactagcagcggtgtctgtgaggggcagctgcacagccccctcttg

SEQ ID NO: 60964 - DNA, 1233 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60965 - DNA, 2860 bp, Homo sapiens
  misc_feature (2685)..(2685): n is a, c, g, or t
  misc_feature (2688)..(2688): n is a, c, g, or t
  misc_feature (2694)..(2694): n is a, c, g, or t
  misc_feature (2699)..(2700): n is a, c, g, or t
  misc_feature (2719)..(2720): n is a, c, g, or t
  misc_feature (2724)..(2724): n is a, c, g, or t
  misc_feature (2729)..(2729): n is a, c, g, or t
  misc_feature (2735)..(2735): n is a, c, g, or t
  misc_feature (2745)..(2746): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccaccnagngtcatntcgcnnttcaaaaattgactgagtnntctnccctntaggcncccaataaanngaccggaaaaaaaaggggcccaaatctccgggccctgccccttggacggcacataggataaaacggggacaagaaacggttgggcactgggaccccaacaatatatcgtgcacc

SEQ ID NO: 60966 - DNA, 3534 bp, Homo sapiens
  misc_feature (2850)..(2850): n is a, c, g, or t
  misc_feature (2862)..(2862): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggcaaaaaaaaagaaacatataaataaaagaaaaaaaaaaaataaaaaaaaaaaaaacgggggggantatatggggggngggggaaaaaggggataaaaatggggggccgtgggtacaatggggtgtttcctgggtcccattattgttttgtaacaagggggaaacgagaatggcgcgcgggggaccgcccaaggggggaggacggagatgaactgtggcgaagaaagccgcggttaaccctgtttataggagaataagttacacacaaggggcctgaggattaacgaaggagaaaaaggaaacaaggggccacacgtagaccacaaggaggacgcgaactcagaaagagggaacactgcggcggtgccaagggaagagagggcaccggtacgtgggagaaccaaagggacccctgtgggaggaaggaatggcgcaagggttgcaacaagagagaaaggagaaaagcgaacttagcccataaaaacgagagggtatcaaggtggtccccgggcgggcgactatgccaggggaccgtaagagacatgggaaaaaatcacagaagggagcaggtgtagggcgcacaccaaacaaaaagcccacaaacaggcggacataaggcagacgaccggagcagcgcgagagaaggacacacaaggacagcgaccaggcggacgcaaagcaccacaactcaagaagggcaggaaacacagcagcgccccgagcgcggacgaaaagaaccagcaaagccga

SEQ ID NO: 60967 - DNA, 2729 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60968 - DNA, 2598 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccaggaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 60969 - DNA, 2722 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggatggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60970 - DNA, 3450 bp, Homo sapiens
  misc_feature (2766)..(2766): n is a, c, g, or t
  misc_feature (2778)..(2778): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaaataaaaaaaaaaaaaacgggggggantatatggggggngggggaaaaaggggataaaaatggggggccgtgggtacaatggggtgtttcctgggtcccattattgttttgtaacaagggggaaacgagaatggcgcgcgggggaccgcccaaggggggaggacggagatgaactgtggcgaagaaagccgcggttaaccctgtttataggagaataagttacacacaaggggcctgaggattaacgaaggagaaaaaggaaacaaggggccacacgtagaccacaaggaggacgcgaactcagaaagagggaacactgcggcggtgccaagggaagagagggcaccggtacgtgggagaaccaaagggacccctgtgggaggaaggaatggcgcaagggttgcaacaagagagaaaggagaaaagcgaacttagcccataaaaacgagagggtatcaaggtggtccccgggcgggcgactatgccaggggaccgtaagagacatgggaaaaaatcacagaagggagcaggtgtagggcgcacaccaaacaaaaagcccacaaacaggcggacataaggcagacgaccggagcagcgcgagagaaggacacacaaggacagcgaccaggcggacgcaaagcaccacaactcaagaagggcaggaaacacagcagcgccccgagcgcggacgaaaagaaccagcaaagccga

SEQ ID NO: 60971 - DNA, 2743 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcctctcagaggaggctcctggctccgagtgggctgtaggggaacagccctgaccgtcaccctccgcctctcctcaggtgcagagtgtcgatatcgcagctttcaacaagatctgaagcctgagtgtgtgtacgtgcgcgcgtgcgtgaggccctgccacgattaaagactgagaccggcgccctctggctccgtcctggtcatttcctgctcgtacctggcctgtctccctccctgtctcagccccatctctgccctgctgttcccacacagt

SEQ ID NO: 60972 - DNA, 2466 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgagtttgaggagccacgtgcagagtgtcgatatcgcagctttcaacaagatctgaagcctgagtgtgtgtacgtgcgcgcgtgcgtgaggccctgccacgattaaagactgagaccggc

SEQ ID NO: 60973 - DNA, 1898 bp, Homo sapiens
  misc_feature (1214)..(1214): n is a, c, g, or t
  misc_feature (1226)..(1226): n is a, c, g, or t
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccagacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggctcagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacagtttgaggagccacgtgcagagtgtcgatatcgcagctttcaacaagatctgaagcctgagtgtgtgtacgtgcgcgcgtgcgtgaggccctgccacgattaaagactgagaccggcaaaaaaaaaaaaaaaaaaaaaacaaaaaaaaaaaaaaaaaataaaaaaaaaaaaaacgggggggantatatggggggngggggaaaaaggggataaaaatggggggccgtgggtacaatggggtgtttcctgggtcccattattgttttgtaacaagggggaaacgagaatggcgcgcgggggaccgcccaaggggggaggacggagatgaactgtggcgaagaaagccgcggttaaccctgtttataggagaataagttacacacaaggggcctgaggattaacgaaggagaaaaaggaaacaaggggccacacgtagaccacaaggaggacgcgaactcagaaagagggaacactgcggcggtgccaagggaagagagggcaccggtacgtgggagaaccaaagggacccctgtgggaggaaggaatggcgcaagggttgcaacaagagagaaaggagaaaagcgaacttagcccataaaaacgagagggtatcaaggtggtccccgggcgggcgactatgccaggggaccgtaagagacatgggaaaaaatcacagaagggagcaggtgtagggcgcacaccaaacaaaaagcccacaaacaggcggacataaggcagacgaccggagcagcgcgagagaaggacacacaaggacagcgaccaggcggacgcaaagcaccacaactcaagaagggcaggaaacacagcagcgccccgagcgcggacgaaaagaaccagcaaagccga

SEQ ID NO: 60974 - DNA, 949 bp, Homo sapiens
ggctccactggttgccatcttccagagccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatcatcccatgtccccgtacatcgttagaagct

SEQ ID NO: 60975 - DNA, 422 bp, Homo sapiens
cccaaagtgctgggattacaggtgtgagccattgcacgcccggccaacagtgtttttaaagagaatcacccccttgtaaacaaacaaaaacaaacaaacatgctgctaagaaattattccaagttggagagaagagcaacaggtgagttccactctattcctcccttgagtttttcctcttctttttgtctggcattcactgcctggatcagcatgcatgctgtatcacagaatatcttctagttttacagaggtagcttgagggaaagaatacagaccatagctattttcagataagaagcttatgttctttaaatacatttatttgttttacatttttttatatttctgattttactttattagtttgactaattttttttttaatttcagccttatttaacttaaggagaatgagatat

SEQ ID NO: 60976 - DNA, 466 bp, Homo sapiens
caataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgt

SEQ ID NO: 60977 - DNA, 248 bp, Homo sapiens
aggcccaagagtcctaatctccagcctactgtacagcagacaacttggccaaaactttgtcaattcattttctggcatgaggaagaattacactgattaacgcaacagtagcttaggggtgggagacagttcaaccaatcagaacaacttgaccaatctgacatcagtactaggggcaatgatatcacttcctacttcttattttatacagaggaaagaagaaaagacttctcagccattaccctaaa

SEQ ID NO: 60978 - DNA, 296 bp, Homo sapiens
gaaaatagttaccattcgttgaaactttgttatactaattggttctttatatttttggtaatttttaaaatgtggaaataatctacctgcataaatgtgaaggccgattgcacacaggtatatcttaattattgtggagtaaattgttataaaatattattaagtggacactcatgttggctcatgttatcatcactgatgtcaatcaaaggagtattgtcaggatcccagaagctgccctctggctgtcctagtgataaacctctcccttccctccaaagtaataactatctcat

SEQ ID NO: 60979 - DNA, 191 bp, Homo sapiens
agacactcaaggcgtgctgataaaagtgttcaaggggcccccttgctagtcccctcagcctcagtagtctcctatcctgaacttgtctggatttctcagttgacaactactcatataatcttgcaatggcttttccattgttgacttgcttacattgttacttagttaacttttcatcatttgtacctctt

SEQ ID NO: 60980 - DNA, 429 bp, Homo sapiens
cttgtctgaccgcagtttgctcatctgcacctactatataaacgcttgcagtgcaccaggatgcagttctaagggctggtggtgcattagacacagtttctgcccttatagaactcagactggtgggtgagaccgattgtacatagagtggattgcaatgtgattttggccacatgcacagatgagaaaagggttgatttgttttgttttgctattttaagacagtattgtttttattttaaaagcagtaaatattacagaatttaggaagtagaaataagcaaatggaggacatttgaaacatccatagtcccaccaacaagagagaactattaatgcttatgtttggccatcagatatttattaaaccccttttgtgttttttctatgccttttttttccttttgtatatatgtgtgcatgtattaa

SEQ ID NO: 60981 - DNA, 700 bp, Homo sapiens
aactgtcaagcttctgatgacaataaaaatgtttcaaatatgtatatatttaaagctcaagttttatcattggcaacaaatactgttgattatttttcttgaaatgtcagggtcactttattcatttttgggaaaacacctgccacatattcatgttgaataactacagtttgccagtcattctttgaagtaaaaatggtgttgcatgaaaaaaagcaactagtccagctcacaactcaatcaaatagtgcttttcttcaaggcaacttcacacttcaatatgcagaagtactttatgtgttcttccattttgtcttccattaatttaaaaagatgggttctcaagaactgatttaataaaattaataatctttacttctacatcgaagacattcttaaatgcagctggccttttttgtttattggtgccactgccttgatttgtggtaaggctattaccagctgtttttacccattagttgcttttgcactatcaatgtaaatgtctatgcagtgaaaaatgcaaataatgttattacaaaaatagttttaaacttacagcctcctaaaggcatttcaggatctctttaagaaaaaaattggccagacatggtggctcatgcctctgttcccaactacacaggaggctgaggagcccaggaggtggtggagattgcagtgagctgtgatcacaccactg

SEQ ID NO: 60982 - DNA, 928 bp, Homo sapiens
gactgaaaacatagatgggggcctgtgcttaggaagagctctctgtatattgatgatctggtgagtaaataaggaaagctcttcaaacatcacatttcatggatatgtttaagattaaagtttaagagtgtgtgggtgaaatatttggtttaactggaattaaataactttactgtggttttcagcaagatgagtggtatttggagttttcctttgggactggaagaaaaaagcaaaaaaataaattttaatttgatttgcatagtgtggcctgatcgtttaagtgttgttagaaagagagatgactaaaattagttgagattattatattatggattaagtatattgaccttattttcattatgattttttggtaccattatgtgttatgagaaagaaatagaaaaagaggcctccctgtggttggcgaagggagtttttgatctttatttcgtgggcgtgatgatgaggggagggaggtggcttacttatttgtcactagcactttgatttgctcagtgtacatttttgtgtataacgttctccccactgtgcaaggcaaattgacaaattgtttattaaataatttgtgtgacctaggaattttaaagaaatgctctgaaaaactggaagtctgaagtttttaaaaatgaaatgtacagactcatctatcttgtataactgctattgtttttgccaaaaaatgagtgaatgattgttttttggaaaatttttcaagtcctgattttatgtctgccttggatgtagccacttcctgaaaacaagtcctaatgtaaaatggacatgtaggaagatgctgcttatatgacatcacgtgtcactgagggaagattgggagtggaggcaggagtttggtggcaggaaaatggaaatgggcagatatgtggcatcgataatgcaaggtcat

SEQ ID NO: 60983 - DNA, 331 bp, Homo sapiens
gttctcaagctctaggagatatagacccctcacagaggcatgtgcctttcttgctggtggagcgcaggtgcacatccacatgtggcccaggcatccgtgaagaggcctactcactggcacgtctccatacctgcactgactccatttatgtatttaagggcagagaaatgcaaagccaagccaggaagagcattcactcttttgacacaagcaggggtgtctctgggtggaaacagaaccagacaaatctcaaggtgggtgagtgtgatgccctctcctcctcttctctactcagcagcctccctgatgcaagctctcttcctttctacct

SEQ ID NO: 60984 - DNA, 813 bp, Homo sapiens
cccatcgccagcccgactcagaagtttctgttttagcttcccacccacaggccaggactgcctcgcctgtctgtgcgtcgtggagaattcagcagtagcgaccccaacatcagagctccccaacttccgggaacttcagagccctcggcctacagcccgggaggcctcgtgcccagacgccatgcaccctccggtaaccagcagccgcctgtccatcccccaagaccggaaaggcagcagcagcccccgggagcccagggctgtcctcggtgcatctggctgcagagggaaattgaggaccttacacagcagctagcggccatgcagttcctcactgacaagttccaggacctttgaagttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcatattcaaaaaaaaaaaaaaaaaaaaaaccgcggagacgaagtgactgctcgctctctgccacagggcgggagggcggcagcaaacattgggggggacgggaccgggggcgcgcccatttctaaaagttacccacttgggtaacacccggaaccagaggcggaccgaacagcggctcgcgtggggcggcccatagaaaaggaatgggcgttgacagtgggaaacacgggtagccattaccccgagaatcacagggagcggggtccaaaaaaaaggcccgggaagtcg

SEQ ID NO: 60985 - DNA, 802 bp, Homo sapiens
tactgggatggcccagcacctgagaaccactttcccgcttagaaggcatttccacatttaattcaggtgacgggtgggtgagtcagtcccagggctggtggggtttctggttgcagggctaggtggttccccaccggggcagggcgtgggtttctgtttccctgggtctggagtgtccatttctgcctctctctttcagcggccatgcagttcctcactgacaagttccaggacctttgaagtgagtgttgcacacaccatgcccctttccacaatcatggtaccttaggagggctgtgggctggccctggctgagggcccgtccctgagcctactctgtttcacaggttggagccagcatcttcctacaagatgaacagctgccacctttggagctccggagctgcagccaagcgggttccctccatatcctgttcagccagggcttcctctcttccgctgcatttgcccccttcccaacgcagttcaaagcaatttgaaataaagtcgttctcatattcaaaaaaaaaaaaaaaaaaaaaaccgcggagacgaagtgactgctcgctctctgccacagggcgggagggcggcagcaaacattgggggggacgggaccgggggcgcgcccatttctaaaagttacccacttgggtaacacccggaaccagaggcggaccgaacagcggctcgcgtggggcggcccatagaaaaggaatgggcgttgacagtgggaaacacgggtagccattaccccgagaatcacagggagcggggtccaaaaaaaaggcccgggaagtcg

SEQ ID NO: 60986 - DNA, 523 bp, Homo sapiens
ccatctgctgccatgagaaaagggaagccgcctttgcaaaacattgctgcctaaagaaactcagcagcctcaggccaattctgccacttctggtttgggtacagttaaaggcaaccctgagggacttggcagtagaaatccagggcctcccctggggctggcagcttcgtgtgcagctagagctttacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaa

SEQ ID NO: 60987 - DNA, 179 bp, Homo sapiens
agcagcttccaaaagtctaaatgaattgagaattgtctcaatatcacaatcaagattttaaggtctggaagtttatgtaaaataatctcagcctaatgtttctggaagttgacaaggaagcctcatgtttctggaagttgtattagggagtatatacaaaaaaaatttagaagctgtga

SEQ ID NO: 60988 - DNA, 332 bp, Homo sapiens
caaaatatacaaataactcttaaatctcaatattaagacaatgagggctgggcaccatggctcacgcctgtaatcccaacacttcgggaggccaaggggggtggattgcttgagctcaggagtttgagaccagcctgggcaacatagtgaaacccccatctctacaaaaaaccacacaaaaaaatcagccgggtattgtggtgtgtgcctgtagtcccagctactcgggaggctgaggtgggaggatggcttgaacctaggaggtggaagttgcagtgagctgattgagccactgcactccggcctgggtgacaaagccagaccctgtctca

SEQ ID NO: 60989 - DNA, 1166 bp, Homo sapiens
ccatctgcgtatgtcttgtattactctttccatcccaaataactttcatcagctgttttaccactgaaatgaaaagtagtcaaaggaaataattatgtttaatcattattggttgtgctataaaataatgtgaatcacagtgggagtgttttgtgagcaaacttcatattactattcccaacacacacacacaggtacacgcaacatatttagtatgcaaaatggaagtattattaatagtggttcaccattcttttacttttctagttatttctcaaggtatggttcacagacccagggagacctttacacatgcttaagattgggtaccattgctttaaacaaacacagcctctggctcctcatagcaaacaataaacttattccaccaggagggaaaaacagaaagaagattcaactacttttggcaaatatatggcaaccttgtcccccatactggattactccctcccatactatacattcactggccacttgtatcgattaatgttttcaaagacagagaactacagttgtccctccgtatccaagggagaccggttccaggacctctgcagataccaaaatccacagacgcttaagtcctttatataaaacggcatagtataacctatgcacatcctccaatatacttcaaatcatctcgtttacttataatacctaatacaatgtattataaatgccatggaaatcattgttacaatgtattatttgtaattattgttgtattattggtttttattgttataaaaattttttccaatattttttatcaggagttgattgaatcagggatgtggaacctgtggatatggagggccaactctattgtacagaagacataaaaaaaaaggaaaacctgggccaggtacggtggctcatgcctgtaatcccaacactttgggaggccaaggcgggtggatcacgaggtcaggagatcgagaccatcctggctaacacggtgaaacccggtctctactaaaaatacaaaaaattagctgggcatggtggtgagcacctgtagtcccagccactcgggaggctgaggcaggagaattgcatgaacccgggaggtgaaggttgcagtgagccgagatcacaccattgcactccagcctgggtgacagagcaagattctgactcaa

SEQ ID NO: 60990 - DNA, 1304 bp, Homo sapiens
ccatctgcgtatgtcttgtattactctttccatcccaaataactttcatcagctgttttaccactgaaatgaaaagtagtcaaaggaaataattatgtttaatcattattggttgtgctataaaataatgtgaatcacagtgggagtgttttgtgagcaaacttcatattactattcccaacacacacacacaggtacacgcaacatatttagtatgcaaaatggaagtattattaatagtggttcaccattcttttacttttctagttatttctcaaggtatggttcacagacccagggagacctttacacatgcttaagattgggtaccattgctttaaacaaacacagcctctggctcctcatagcaaacaataaacttattccaccaggagggaaaaacagaaagaagattcaactacttttggcaaatatatggcaaccttgtcccccatactggattactccctcccatactatacattcactggccacttgtatcgattaatgttttcaaagacagagaactacagttgtccctccgtatccaagggagaccggttccaggacctctgcagataccaaaatccacagacgcttaagtcctttatataaaacggcatagtataacctatgcacatcctccaatatacttcaaatcatctcgtttacttataatacctaatacaatgtattataaatgccatggaaatcattgttacaatgtattatttgtaattattgttgtattattggtttttattgttataaaaattttttccaatattttttatcaggagttgattgaatcagggatgtggaacctgtggatatggagggccaactctattgtacagaagacataaaaaaaaaggaaaacctgggccaggtacggtggctcatgcctgtaatcccaacactttgggaggctgaggcaggagaatctctggaacctgggaggcggagacggcagtgagccaagattgtgccactgcactccagcctgggtgacagagcaagactgtctcaaaaaaaaaaaagaaaaaaaaatttaaaaaaaaggaaaaccagtgtcaaaacactaaaatgcattccaaaatcaaaatcaagtggctatgatttgtggcactccttcgaattagcagtgataatcaagaaatgaaaattgcaattatttctcctgggaaaactactcttagtactatacactatatgcagatgaaaatggtaagggctgagaaggtaacagtgttcagttggtattttatttctcctggaagatgcaggattgggagggaggcaag

SEQ ID NO: 60991 - DNA, 465 bp, Homo sapiens
tttaatttttcctcattattctaaaacttagaactcctccatatataattaaaagtgtgaaaatctaaaaatacttctgccagtacaagatgcacagacacatacacacttaattcaaagacatatgggtacttagaatattgaagtattttctaaattgttttctattttactcagatcatttctagcaccaactcaacctttgctttttggatgagtttggtaaggattaattctacttccaatttggtgtgtttggtgtgccaaaatgtatctattataagatatgttatattgcatacaagtggaagtaggtggagtattcctctgttataaagagtatttacaaatttccattgggaaatatcagctgctcactattatctgcagtattgataagactacagctatatctttatccatttattctccattaaagaaattgtgataaactgcaaaataatg

SEQ ID NO: 60992 - DNA, 1026 bp, Homo sapiens
gacgccctctggatccagttaaagtaacatgcctccgaggtactgcatccttccgctcagtgtcaccatctgtgatctcatttcaccgcattggctgtggctctccccgtacaagtgttcagccttctgtattttgatttctttctgctgagaacgtctaggcttcatgtggcccatctactcagtcttgagaagctcttttaaaaacctccgtttgccttagcgttgttgttctctcttagtggtacataagcatcgcatagcacctcatgtttcacgcttcaaattcagattttctttgctgccagagaaggccacctccagcaaaactggagcataggggaacacacagaagaagggaaggtgtggaaaatttttttaatgggtacaatgttacctcatttccagttctagtttgtgtccccttctaataccttctcaagaatacttggcccaactccttaaatttgtttaggattaattctccttaatgctaaaatacaccttgcccagtagaacatttctcttttggttaaaaaaaaaaagtttctattaagtgtactgcagagataatacgacttcagcagtattaatagctgattactttgcagttgatctgcactattgtaggccaggcagaggggtgggaaggaggaatcaggaggtatccagttgattcagcaagtgcaaatacagacctagacaaatagaagtgttatagtgccaacaaaacattgttcacacctgaaaaatccatatcaaaaagctcaatattaacctatacagttcagtggcagttttattggctggaaagacttaatattgatttactgaaatagggataaaaatttttcctggtgaggaaatcacagtaaaaaaaaaagccggattatcactgctaaggccctagttattggaaagaatactctacttctgcactccctcctgagatgctcacagtgattctggacattatgtgcctaggatgcatatgtagtttttgttagcagctgagattccctaggc

SEQ ID NO: 60993 - DNA, 4149 bp, Homo sapiens
  misc_feature (2718)..(2718): n is a, c, g, or t
  misc_feature (3151)..(3151): n is a, c, g, or t
  misc_feature (3954)..(3954): n is a, c, g, or t
  misc_feature (3964)..(3965): n is a, c, g, or t
  misc_feature (3971)..(3971): n is a, c, g, or t
  misc_feature (3973)..(3973): n is a, c, g, or t
  misc_feature (3981)..(3981): n is a, c, g, or t
  misc_feature (3989)..(3989): n is a, c, g, or t
  misc_feature (4015)..(4016): n is a, c, g, or t
  misc_feature (4020)..(4020): n is a, c, g, or t
  misc_feature (4022)..(4022): n is a, c, g, or t
  misc_feature (4029)..(4029): n is a, c, g, or t
  misc_feature (4032)..(4032): n is a, c, g, or t
  misc_feature (4049)..(4049): n is a, c, g, or t
  misc_feature (4066)..(4067): n is a, c, g, or t
  misc_feature (4073)..(4074): n is a, c, g, or t
  misc_feature (4076)..(4079): n is a, c, g, or t
  misc_feature (4085)..(4085): n is a, c, g, or t
  misc_feature (4090)..(4090): n is a, c, g, or t
  misc_feature (4095)..(4095): n is a, c, g, or t
  misc_feature (4106)..(4106): n is a, c, g, or t
  misc_feature (4116)..(4116): n is a, c, g, or t
  misc_feature (4118)..(4119): n is a, c, g, or t
  misc_feature (4126)..(4127): n is a, c, g, or t
  misc_feature (4130)..(4130): n is a, c, g, or t
  misc_feature (4133)..(4133): n is a, c, g, or t
  misc_feature (4148)..(4148): n is a, c, g, or t
gagagttacaattgtttttgcatcagaatgattatgggacagaaaagggcatttcatgcaaatggacaccaaaagccagcagcagtagctattctcatatgagacaaaacaaactttaaagcaacagtagctaaaagagacaaagacaggcagtatataatggtaaaggtctcatccaacagaaaaatatgacaatcctaaacatacatgaacctaacactggagctcccaaatttataaaacaattactagtagacataagaaatgagatagacagcaacacaatgatagtgggggacttcaatactctactgacagcactagacaggtcatcaagacagaaagtcaacaaagaaacactggatttaaactatactttggaacaaatggacttaacagatatatacagaacatttcatccaacaaccacagaatacacattctattcaacagcacatggaattttctctaagatagaccatatgataggccataaaatgagtctcagtaaattgaagaaaattgaaattgtatcacgcactctctcagatcacagtggaacaaaactgaaaatcaactccaaaaggaatcttcaaaaccatgcaaatacatggaatttaaataacctactcctgaatgagcattgggtgaaaaacgaaatcatggtggaaatgtaaaaaatttcttcgaactggatgacacaacctatcaagacctctgggatacagcaaaggcagtgctaagaggaaagtttgtagccctaaacaccgacgtcaaaaagtctgaaagagcacaaacagacaatctaagttcacatctcagggaaccagagaagcaggaacaagccaaacccaatcccagcaaacaaaggaaataaccaagatcagagcagaactaaatgaaattgacacaagaacaacaacaacaaatacaaacataaataaaacaaaaagttggttatttgaaaagataaataaaattgatagactattaccaagattaaccaagaaaagaagagagaaaatccaaataacctcactaagaaatgaaacaggggatattacaaatggaaccactgaaatattaaaggttattcaagggtactattaacaccttttggcacataaactagaaaaaatagaagagttggataaactgctggaaaaatacaaccctcctaacttaaatcaggaagaattagataaaaaaagcagaccaataaatcaagcagcaagattgaaatggtaattttaaaatttccaaaaaaaaaagccgaagaccagacagattcagagcagaattctaccagacattcaaagaatgtcttctttcattcaaagaagaaatgataccatcctttcacactattccacaagacagagaaagaagaaatcctcccagattcctagagcggacagggcgatggcaggttcgccgggtgtgaggcttcacagcggtccggtgaccaagtcgaggatttttctggtggtctagtctcagagattacatctgtagtcagcacaatgattcccttccaagcccagtggtgcccagttgcctccaggtcccagacctttatgtggacaagaaaagcttacagaggaaatggtaattctccacttgcacactgaggtgtccagttgcagcccatggagatccagttcaattatgaatctcaggaacaccaccttctgtcagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggggaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagtcagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatnagatcttgttaaacatcacagaattcatacaggtgagaaaccctatgaatgtgatgaatgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattanacaccagagaatccacactggggaaaaaccatataaatgcagtgagtgcaggaaggctttcagtcagtgctcactcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccgcactggatccggatacgtgtggtggctcacgcctgtaatcccaacactttgggaggcagatgtggaagcatcatttgagcccaggagtttgaggctgcagtgagctatgattccaccattgcactccagtctgggcaacagagcaagaccctgtctatttaaaaaaaaaaaaaaaccaccaataccacaggggagaaaacattaattcagtttttgtaatgaaaggttaactcagagctcagacattaactaaaattaagaaaaattctccagcctgnccaacatggnnaaaccntntctctacnaaaaatanaaaaattagctgggcatggtggcacnnctgnantcccagntantcgggaggctgaggcangagaatcacttgaaccnnggaggnngnnnntgcagngagcngagantgccactgcantccagcctgngnnacagagnnagnctntctcaaaaaaaaaana

SEQ ID NO: 60994 - DNA, 625 bp, Homo sapiens
ggcctggtttaacctggcccccgggagtacggatcaggcgatggcaggttcgccgggtgtgaggcttcacagcggtccggtgaccaagtcgaggatttttctggtggtctagtctcagagattacatctgtagtcagcacaatgattcccttccaagcccagtggtgcccagttgcctccaggtcccagacctttatgtggacaagaaaagcttacagaggaaatggtaattctccacttgcacactgaggtgtccagttgcagcccatggagatccagttcaattatgaatctcaggaacaccaccttctgtcagactaggactcaatgaaattgctgcccccatgttcctgaggctctgcaagctgaagcttatttctcatgatataggcaagaaaaatgtgtcaggttgccaccaccttcctccctgggccagaattttctgctcttacaatgctgatgattgtctaagattgcaccatccaccctggaggttgctgactcccatttgattgctggcctgccactcatcctgtgctgttttcttggagcctgacctcctcagtgattgctgctggagagactgaatggtgcaacctggaagtgcggtgtagctgatgctctg

SEQ ID NO: 60995 - DNA, 2786 bp, Homo sapiens
  misc_feature (1355)..(1355): n is a, c, g, or t
  misc_feature (1788)..(1788): n is a, c, g, or t
  misc_feature (2591)..(2591): n is a, c, g, or t
  misc_feature (2601)..(2602): n is a, c, g, or t
  misc_feature (2608)..(2608): n is a, c, g, or t
  misc_feature (2610)..(2610): n is a, c, g, or t
  misc_feature (2618)..(2618): n is a, c, g, or t
  misc_feature (2626)..(2626): n is a, c, g, or t
  misc_feature (2652)..(2653): n is a, c, g, or t
  misc_feature (2657)..(2657): n is a, c, g, or t
  misc_feature (2659)..(2659): n is a, c, g, or t
  misc_feature (2666)..(2666): n is a, c, g, or t
  misc_feature (2669)..(2669): n is a, c, g, or t
  misc_feature (2686)..(2686): n is a, c, g, or t
  misc_feature (2703)..(2704): n is a, c, g, or t
  misc_feature (2710)..(2711): n is a, c, g, or t
  misc_feature (2713)..(2716): n is a, c, g, or t
  misc_feature (2722)..(2722): n is a, c, g, or t
  misc_feature (2727)..(2727): n is a, c, g, or t
  misc_feature (2732)..(2732): n is a, c, g, or t
  misc_feature (2743)..(2743): n is a, c, g, or t
  misc_feature (2753)..(2753): n is a, c, g, or t
  misc_feature (2755)..(2756): n is a, c, g, or t
  misc_feature (2763)..(2764): n is a, c, g, or t
  misc_feature (2767)..(2767): n is a, c, g, or t
  misc_feature (2770)..(2770): n is a, c, g, or t
  misc_feature (2785)..(2785): n is a, c, g, or t
gcgcggtgaagcgccatagagctgagcactcctcccagattcctagagcggacagggcgatggcaggttcgccgggtgtgaggcttcacagcggtccggtgaccaagtcgaggatttttctggtggtctagtctcagagattacatctgtagtcagcacaatgattcccttccaagcccagtggtgcccagttgcctccaggtcccagacctttatgtggacaagaaaagcttacagaggaaatggtaattctccacttgcacactgaggtgtccagttgcagcccatggagatccagttcaattatgaatctcaggaacaccaccttctgtcagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggggaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagtcagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatnagatcttgttaaacatcacagaattcatacaggtgagaaaccctatgaatgtgatgaatgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattanacaccagagaatccacactggggaaaaaccatataaatgcagtgagtgcaggaaggctttcagtcagtgctcactcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccgcactggatccggatacgtgtggtggctcacgcctgtaatcccaacactttgggaggcagatgtggaagcatcatttgagcccaggagtttgaggctgcagtgagctatgattccaccattgcactccagtctgggcaacagagcaagaccctgtctatttaaaaaaaaaaaaaaaccaccaataccacaggggagaaaacattaattcagtttttgtaatgaaaggttaactcagagctcagacattaactaaaattaagaaaaattctccagcctgnccaacatggnnaaaccntntctctacnaaaaatanaaaaattagctgggcatggtggcacnnctgnantcccagntantcgggaggctgaggcangagaatcacttgaaccnnggaggnngnnnntgcagngagcngagantgccactgcantccagcctgngnnacagagnnagnctntctcaaaaaaaaaana

SEQ ID NO: 60996 - DNA, 341 bp, Homo sapiens
aaaatatccaaaattatgccacggtaatggtggcacacgccctgtagagcccagctatcttgggaggctgtaggtatggaggatcaccttgagctcacaggagcgtcgaggctgtccgtgaagctgtgaaacgtgccactggactcccgcctggtgatggagtgagaccctgtttccaaaaccaccattaccaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaa

SEQ ID NO: 60997 - DNA, 958 bp, Homo sapiens
aagtcaaaataatgtaacaaagctgatgtactttactcattagaacaattcttcacaatttaatattaattttagatatacatagttcatgtttgataaccagatcaatactgagtgaaaaatagcatagtgggaagagcaggggaggggaggtagggatctggagacctagagtgtacttccatattgcaactagtgagcagtaggactttgagaaagttacccaataggcctcagggttctaatttataaaatgggtatgatatgcctgccttatctgtcttgggaacttaagtaaggttaaaatgaactaatgaacttgaaatgttttataaactgaaaatgctatacgaatgtgagattgatcttgtatttcaatagtcccaacaatatcactgcattgttatattaggtggaataaaaggacaatatttaactgttttgactctacaatagtgtcaatttagttgtgttcagctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatctcagctacttgagaggctgaggtgggaggatcacttgattccagaggcagggcttggttgcagtaagcagagatcacgtctctgcactccagcctggctgacagagtaagaccgtgttcaccaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaa

SEQ ID NO: 60998 - DNA, 1639 bp, Homo sapiens
aagaaaatgatctgtcttctggtaggtgaattatatcttcgtttttaaaaaccaatggctgtttaaactctgtgcacaccaggggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggccggctgtggacccccgcggcctggggcaacccttcctggtgcccgtgcccgcccggccgcctctgaccaggggccagttcgaggaggcccgggcccactggcccacgtccttccacgaggacaagcaggtgaccagcgccctggctgggcggctcttctccacgcaggagcgcgccgccatgcagagccacatggagcgggcggtgtgggcggcccggcgggcagcagcgcggggcttgcgggccgtgggggccgtggtagtggacccggcctcggaccgcgtgctggccaccggccacgactgcagctgcgcggacaaccccctcctgcacgccgtcatggtgtgcgtggacctcgtggcgcgcggccagggccgcggcacctacgacttcagacccttccccgcctgctccttcgccccggccgctgccccccaggccgtccgcgcaggcgccgtgcgtaaactggacgcagacgaggacggcctcccctacctgtgcactggctacgacctgtacgtgacccgcgagccctgcgccatgtgcgccatggccctggtgcacgcacgcatcctgcgcgtcttctacggtgcgccctcgcccgacggcgccctgggcacccgcttccgcatccacgcacggcccgacctcaaccaccgcttccaggtgttccgcggggtgctggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaacca

SEQ ID NO: 60999 - DNA, 820 bp, Homo sapiens
tccaccagaaaccatcggctaggtgcgaggctgggtggtgcgctcgcgcccggatccctcagggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggccggctgtggacccccgcggcctggggcaacccttcctggtgcccgtgcccgcccggccgcctctgaccaggggccagttcgaggaggcccgggcccactggcccacgtccttccacgaggacaagcaggtgaccagcgccccttgctgcgtttgtgtcccctctgtctcgcgggccgggaaactgctctgatgggaaaataaacagcccaaaacca

SEQ ID NO: 61000 - DNA, 1618 bp, Homo sapiens
tccaccagaaaccatcggctaggtgcgaggctgggtggtgcgctcgcgcccggatccctcagggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggccggctgtggacccccgcggcctggggcaacccttcctggtgcccgtgcccgcccggccgcctctgaccaggggccagttcgaggaggcccgggcccactggcccacgtccttccacgaggacaagcaggtgaccagcgccctggctgggcggctcttctccacgcaggagcgcgccgccatgcagagccacatggagcgggcggtgtgggcggcccggcgggcagcagcgcggggcttgcgggccgtgggggccgtggtagtggacccggcctcggaccgcgtgctggccaccggccacgactgcagctgcgcggacaaccccctcctgcacgccgtcatggtgtgcgtggacctcgtggcgcgcggccagggccgcggcacctacgacttcagacccttccccgcctgctccttcgccccggccgctgccccccaggccgtccgcgcaggcgccgtgcgtaaactggacgcagacgaggacggcctcccctacctgtgcactggctacgacctgtacgtgacccgcgagccctgcgccatgtgcgccatggccctggtgcacgcacgcatcctgcgcgtcttctacggtgcgccctcgcccgacggcgccctgggcacccgcttccgcatccacgcacggcccgacctcaaccaccgcttccaggtgttccgcggggtgctggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaacca

SEQ ID NO: 61001 - DNA, 1154 bp, Homo sapiens
aagaaaatgatctgtcttctggtaggtgaattatatcttcgtttttaaaaaccaatggctgtttaaactctgtgcacaccaggggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggcctcccctacctgtgcactggctacgacctgtacgtgacccgcgagccctgcgccatgtgcgccatggccctggtgcacgcacgcatcctgcgcgtcttctacggtgcgccctcgcccgacggcgccctgggcacccgcttccgcatccacgcacggcccgacctcaaccaccgcttccaggtgttccgcggggtgctggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaacca

SEQ ID NO: 61002 - DNA, 403 bp, Homo sapiens
tggccagctgagactgtggtttgggggtgttcaggtggggtggatgccagagatgtgggagccagaggcgtggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaacca

SEQ ID NO: 61003 - DNA, 564 bp, Homo sapiens
aatgcttgacctaaccgttgcctgtgtataaaccactggatggaatctgaaagacttggcagaaccagaagcactgggaggaaagtgagctgccctatagcaccgtcaggagaaagatgacaagactgttactagatccatggaggatctgcaaaaggatgctgtaagataaagagaagtaagggagaaggaaagatattgactccaaatgtctagactatccagaacaagcacctaaagatttaatttataatattaaaaacccaaagtataggctgggcacaatgcctcacacctgtaatcccagtattttgggaagccaaggcaggtggatttcttgagtccaggagtttaagaccagcctgggcaacagagtgagaccccatctttacaaaaaatacaaaaaattagcctggcgtggtggctcatacctgtagtcacagctactggggagacggaggtgggatgatcactggtgcccaggaggtggagattgcagtgagacgagatcgagccactgcactccagcctgagcaaccaaacaaaactctgtctcaaaaaaga

SEQ ID NO: 61004 - DNA, 484 bp, Homo sapiens
cttcagccttttctaacttggcttaactgtcccctcctgaaggagcttctagctcaagaaggaggaacttgaaagaacagacacagcttcgccgtgggtggtcgacacctacatgtttgtatctgcacatgttcagtgtgttacttctagatgcttctttattgcttctatttggacctgtatctgctgataaaactgcagatacaccacaagaagaaaacagagtgaatgcattgtgagaaataactgcatgtctgttttagaatgactttttatttcaaaattaaatttaggatacaaaaagaaggatgccatgttagttctaaaagctatccgcagattatccaatttaggatgtcttagtggttatatccaccaatttaaactttttcctgtgacttgacagagtgatcaataagccaagccttagtatattgctatatgcagtccaattgtgttctataacattacctcacataaaaaa

SEQ ID NO: 61005 - DNA, 227 bp, Homo sapiens
actgtactggtttttagtatggaaactctgcccacaaaccatgtccttgtgacatttacgtacacatgatagaataaaacatgctcctcattcaaacaccagaagcaccatggccattttagggaagatgtctctgcccccttgttccaggaatattttattctatctcactcttggttttggttctccttggtgattctagaaggtgaatgcctgtgccaaccatg

SEQ ID NO: 61006 - DNA, 464 bp, Homo sapiens
tgaaatgaccctgtcaagagattcatattgtgggtacagtaggtgttgaaatatacatggtgacttcctggcagttacaatatcatcctcatcacagaattgccacacaaatccctacagaagccaaaatgtcaggaggtccttgttcctaatgctccactgactcagtgcatgacccagggcaagccacttaactaatcttggtcttaacgtccccattaatagtgtctgcattgttgatgggaatcctccctgtgtataattcttctatcatggaatgtcaatgaatggatcttgcaaactcagctacagacaaactcagctcctgccaggagacagccgctctcagaacaaagctcatatttgcctccttccaagagtccttagcaaaccacgttttgatggaatggctcctgcttcacactgactgagagagaattccctcggcatagcctgagtgactt

SEQ ID NO: 61007 - DNA, 492 bp, Homo sapiens
ttactgaacacacactatgtgccagaaactgctagcattggaagtagagctgtgaacaaaatcaagcatcaacatttctgatatttgagaagataggcaacaagcaaatatgtgatgtaaagtagtgataagtgctgtaaaatcacaagagggtatagaatgaggattgttcttcaagttgatagaacagatctttaaagaagtgatttgaggctgggcgtggtggcttacacctgtaatcccaacactttgggaggccgaggctggtggatcatgaggtcaagagactgagaccatcctggccaacgtgctgaaactctatctctactaaaaatacaaaaattagccaggcgtggtggtgcgtgcctgtagtcccagctactcgggaggctgaggcagaagtgcttgaacccgggaggcggaggttgcagtgagttgagatcatgccactgcatgccagcctgggcgacagagcaagactccatctcaaaa

SEQ ID NO: 61008 - DNA, 450 bp, Homo sapiens
gacttactgctcctccattgcccatcctggacacacacgggcaaagggttcccaggcttaccactggggtggcgagggaggacccaggaagacgccgtgtgctccattcacccgctgcaaagtatttttggaggatttgctgatatgcaggcagcctggggtggtggattgagtgtgggccaccccaagaggcagctggaaagtggggtacggcctgggaatggaccggaaggcatgcctgcagggtcctcgtgcctgctgtgagcactcagcacctgcaccagaggaaggacagagtgaaggagggaagagggagaaggaaaggcatcttgacctcctcctctcctctccttatgcctttaagcattggcatgctaagccctgggccgccatcactgcacttagtccttctagcactagtactaccccttcttatagacaaccaaggct

SEQ ID NO: 61009 - DNA, 1287 bp, Homo sapiens
gcaagatgagcaacaaaagaagaatcccaagataatcacgtaattatgttaggagagattctcagttcaatctaatcctgtctaaacaggctgaaagaaattagtcactcagaattatataaaaggctctattgaggacacagaaagaagaggcccatctgtaaaccaggaaaaggaccctcatcaaactgagctctgccaacacactgatcttggacttcccagcctccagaattcttctgatagttgcttttggggatcgatgaatcgcttgagaatctctgattgggcaaaaggcctaagtgtctataagaagctgaggagctggagtgggagcagaaacgtctggcagggtgaatggaggtgaggaagaggcagaggactgaaggaggatatagcaaaggatgccaaaagccaaatggaagatcaaaggtggtaaaaagaaaaggtggaaaagcagagctggaagaagtgggattaatccatatggtaaagaagaaaatatagatatttggaccgaagaggttaaaaaagtcaatggatgacaccattctctgaagaaaattaaagaggaatccaaactcattgtatgaggccagcattacgctgatacctgatccacagaaggacactagaagaaaagaaaatcacaggctaatttccttgatgaacatagatgcaaggatcctcaacaaaataccagcaaaccaaattcaacagcacattaacagtgtcacacatgagcaactggaatttatccctgggacggaaggatggttcaacactggcctattgtttttaaggctttctggctctggaaactgtaaactcttgcctccaaaatgacctcaggagtctcccaggaattacaggagactattccaaggtgcaataatttatctctcaaagagataaaagtttaattttaatttttctttcttctgctttactgaattaatttatgaaaattctatctggactttatagcctcttttacagactgcttacaatatgcagtgtactttagatatgcttattcagtagttaaactccttttactgtgtcttatggagagggctccctctatcattttttgttttctcaacactatatagtcaatatctattaagagaagttctgaaagaaaaacactgaaagaggaggaaaataataaaaggaacaattagagcaatacaacataaatgcctatagccaaacaactgaaggagttttcatatttaaggggccccatgagtatctcattaaatgagtgaaaaaccacttata

SEQ ID NO: 61010 - DNA, 520 bp, Homo sapiens
cacagtttcagtcactgcttgcagagtccaattaacaagagcgaggtatggtaggggaaaattgactttatttccaaagttggctaaggggaagtggctggattcctatccaaagcaaccagtttgaattttgaggtggaaaggcaagcgtttaaaaagggaagacctgatatggaagggatgcaggaattgcactgagttttattccagtggctatcttgggtcccggtccacctggagtgtgggctggcgttcatctcaacaatggccaggttgttgattagccaccttgaggtaatctctggaattctgcagctgggtctccaggcttgatctgtctctctcaggatttgtccctggaacttctaagtaggcacctagttagatactaacatatagttagataaatgtgaagggcgtgtatacggtgagaaagggagggatggggagtctattttaaggctaagggaaaaggcttctgcagtttgcttcaaggttacatcttgaaacccaagagaaa

SEQ ID NO: 61011 - DNA, 197 bp, Homo sapiens
tattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaac

SEQ ID NO: 61012 - DNA, 564 bp, Homo sapiens
ctgtaaaatcaatttatttcaactttacttttgaaaatagtccaaagtattaatatattagtttatttttttggtggtatgccaaacattataaaactgctagttttagatgtagacagtgagtaaagattgagctaaatctttatagattgtggccttttggggcatttggtaaaagataatcctatttctgtaaaacaaatactgaaaagagaaaaaaaaaagcacatatgtatgtgtatgtccatctaagattgtttaagcctggaaaaacatggaaggatatatatgaagttgttatcatgggtttgcctgacagtgctgatgcgggtggaagaggagggatgggagaagctgtgcaaatgtatgagaaagggactaaaaagggatgtctattatgatatttatataaatttatttctaggtgtggctgtatattgaaaaaatgagtaaaatactttaaaaagtgatctggaaaatgagaaaagaaaaatgagtgtaattctcatgtgcgtttaaaattataatgtgtcaaatgtttgtctaaattggatgatcactaag

SEQ ID NO: 61013 - DNA, 205 bp, Homo sapiens
catataatgcttcgttgaggatcagttgttgagtcgtcagtcattgacaggggcaaaaatatagttgtgttagttgatagcctagcttaattcttaggaaggcacttcatttcccaacctttttctattatttagccttgcactaacttccaccattgaaactatttctcttagttttcctagtgtcccaatgaaattataactt

SEQ ID NO: 61014 - DNA, 522 bp, Homo sapiens
tcccaggataccctaaaatagaagtgcttaaactttgtcaggcagaaggtaaagtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagagggacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagattaatgataacgtaaaagtatattgattaaaattccccttacaaagta

SEQ ID NO: 61015 - DNA, 837 bp, Homo sapiens
tcccaggataccctaaaatagaagtgcttaaactttgtcaggcagaaggtaaagtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagagggacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagattaatgataacgtaaaagtatattgattaaaattccccttacaaagtatattttgatgtttgtttattctacctcaaacagaggcttaagttttgaagtgtaaccagtttatacttcattttatacaaaacttattgctgagaagtctgaatattgtgctttttgttgtttgtaaatagaattgaatttaaatacaccaggataaatcttatttaaaggaagcctgtttgaaaatcaccaactttaacttattgcttatataaatccaagctctgtacctgatctttatgtaaagcaagattcatatgtgtagtatctaatgccctttggtgttacatttgactaaaatacaaatgtctgtat

SEQ ID NO: 61016 - DNA, 1085 bp, Homo sapiens
ggagagagtgccaggtagtaggtcctgaaggaacttgtccaggaggaggaaagacggcctcacagtttcccatctgctagatgggctagtggcaaactagagggctgagtggcaaacataattttagtttgagaggtaaataaacaaataaacaaaaatctcctttcttctcccaaaatttatgccaagaggagagccaccatccacctaggcaacttaagaagaaagtttgatgtaatcttcattaattacctagagatctcatgctatgcatataagatatggaacataatagtaatatcagacacttccatggtgtttaccatgtgcaaggcattgtcccaagggctctatacacaggtgcatttgtagaactcatttaattctcacaaccatcctatggttgtgtaactcatctatttctctttgtagttaagcgacttgcccaaatgtcatgtagcttataagtgacagaaacaggcatggaacctaggcaggctgcctctaaaggacatatatctatttctaccatgtcacaatcctcaccaaaggctttggaaggcagatagcaaacctccagcaaccagagactgtgctgctgtgtctgtataaaactatctctctggcgttgttgagagtaaaaattaaaagtgccaatcaccagagaccccaccttaattcaaagggcaatgggagctgcacattaactgtggctgccctctgcatactgctggctgtgatgtcaacactgtgtttatatgaaatccttcagccaatggcagcatctttaaggcatcagccgtttgcttgcagaatgggcttctcagttttttacgcattttttttttctttctagaactgggttcaggtggataggctctaaatagaataccatgccaatgccaattatattcagaaagtattgcaatttctctttgatgcttatttacattaattaagagcaaacttagataaagaagggtacaagtttaaatgctaaaatcctgaagtgagatactttatagtctggaaaaatatacagaactgactttccttctgaaaaaaaaaaaaaaaaaaaaaaaaaa

SEQ ID NO: 61017 - DNA, 745 bp, Homo sapiens
ttattgtttctagaagctttttacaaacatggttttatttgacccttataacagtttggttaggaataagaacagattcaccaatgtgtctaatttataggtggaaaacaggctcagaagctctttagaatatcatgagaagaagggatgtggggaattattcaattcaacttctgtattttgcacttcaagaaactgagtaccagagttaaaaatctggacatttggtggatgttcttagatttgtgttaatgcaagagggttggattagatgatctcacagggtatgggaatggatggtgtgttccctgtatctactgtgtagtgtaaagttaattgatactagctcaacatattagattaagtggcattttagcaaacatgaatgaaaggcaccaaaggtttaagggggaatttaaaacattaggtagcagcttgtagaggatatatttagggtcatgatgtccttcttgttggccttaaaaacacttcctgcgccaggttcaagggtcaattgggaacaggatcaacagaggatgagggtttttttttgtttgtttttgtatcattttaagacaaggtctcactctgttgctcaggctggagtgcggtggtacaatcccagctcactgcagcctccgcctccctgagctcagatgatccttccacctctgcctcctgggtagctgggactgcaggcacatgtcaccatgcctggctaatttttgtatttttcgtagagatg

SEQ ID NO: 61018 - DNA, 340 bp, Homo sapiens
  misc_feature (323)..(323): n is a, c, g, or t
atgggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagacnactctcctccgcccatt

SEQ ID NO: 61019 - DNA, 221 bp, Homo sapiens
  misc_feature (1)..(5): n is a, c, g, or t
  misc_feature (221)..(221): n is a, c, g, or t
nnnnnattcacattaacacgtgcacatcttctcctcacctaacaaagcatagaaggatacggcatttctcactctgtgattcttagttcaaaatgtcccaaaatatgaaaatagaagcaacttccaactgagaaactgtttttcccccactaaacaagcaaagcctatatcttccctgtggacccctgacacagctagctgcagggagtgttgctgggtgn

SEQ ID NO: 61020 - DNA, 513 bp, Homo sapiens
tgcatagaatacatcctcccttcagttggcttgggtcaacttaggtcatgggccacctggctgatagcagtttccacagaaatgcttcaagatggaatctctggacactccaagggttgatcctctcatggaagaccagtggggaggaggctgcgggaaaggtcaggcactgtgcacttccctgacagctgcaaatggttgtttccaagcccactggtcactacaaataagaatttctggtttttcctgttggagcccaaggagcaagggcagaatgaagaacatgatgtttcctaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttcctaaaatata

SEQ ID NO: 61021 - DNA, 769 bp, Homo sapiens
aaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctatgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgaatttctggtttttcctgttggagcccaaggagcaagggcagaatgaagaacatgatgtttcctaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttcctaaaatata

SEQ ID NO: 61022 - DNA, 740 bp, Homo sapiens
aaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctatgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgaatttctggtttttcctgttggagcccaaggagcaagggcagaatgaagaacatgatgtttcctaccgacagttactcatgacgtctccatctaggactgggggcatccttctccatccagtattgggggtcatcctcctccatccaggacctgaggggtgtccttttctgcgcttccttggatggcagtctttcccttcatgtttatagtgacttaccattaaatcactgtgccgttttttcctaaaatata

SEQ ID NO: 61023 - DNA, 515 bp, Homo sapiens
aatccgctgaagggcgggttgcagctctcctgcagctgtgggccgactgcctgactttggccactaggtggcctctggctctagggtttcggggccgctggtgtcggcgggcagagtccgggtttgccaccgctgcccacaggctcaccatggcctgactaaatgctcgcactgctcatacatccacttttaaaaattgggttgaacatgagaacataatcattcatattttatccatttgcatgtattcaataccatcctttcgctgttcttgtctctgcagcctttttctttaaagaatgaatgtttccatgttttatatccacagaatttctggtttttcctgttggagcccaaggagcaagggcagaatgaagaacatgatgtttcctaccgacagttactcatgacgtctccatccaggactgaggggggcatccttctccatctaggactgggggcatccttctccatccagtattgggggtcatcctcctccatccaggacctgaggg

SEQ ID NO: 61024 - DNA, 830 bp, Homo sapiens
attttaggcagaaggaatggcaatttctgaacgggggcacaggaagggaaaacctaaacagaacccagtagtctctctgagctgagaagacacaggatgtgactgttatttgcaaggcacacttcttgagaggaaaaaaaacagctccagaagtttgcttcaggccctcttaagtctggctgaaaattaatctgtgctgtgtagggagaaagtctctatgaccagacagagaaaactggcaaggaaagaacatcttactggggagctgtgagatgagcctttctcagcactacctcagagccatgaatcattcgggtcctttaccacctggaatgtagagacctcactgaatacagggaaaatcacgtagagccccgaggagggtcatgtcttagtagtgcggctaaactagcctcagtaaaggctaccctagatccacccataataattttaaaaccagttgttgaaataatcaagccattcctcaagtggtttagctggcaaacaaagttcaactttttttttttttttaacaagactacaacaaaatccagcaagcaataatataaaatttacaatgtctgtcatccaatcaaaattactaaacattcaaagaatccagagcatatgactcataaccaagataatactggttagtaaaaacagattcattaatgatgcaaatgagagaattagcaagcaatgatctattaaaaggctattacaaatattataattatattgtttgccctttaaattcaaggatttaagaaaagacatcaccataatggggcaagaaatggatgatttttaaaaaagaacttcttgat

SEQ ID NO: 61025 - DNA, 362 bp, Homo sapiens
caggaccagaggtgtcgagatcgtgtccaggacctgagctggctcagggtggagcccaccgggctaggtgtccaggcctgggcctctgtggaggaccagcccttgcagctcagcacagaggctgtggagcaggtggcacacggcagccagctggactctgagccccgctcagcccctgctgcccggtggagttcccagggccaccatccagaaagcctgggcctcactttgaacagccagcaggaagggggggtctctgcaagtgccccagaatgccgctgcagcctcctggcccgtgagggcctcctctgtggccagccagaagtgggggcctctgggccagccatggctgagccccatct

SEQ ID NO: 61026 - DNA, 231 bp, Homo sapiens
cgcctcagcccaaaagctcttggaggcgtgtgtgtttgtgtgtgtgtgtgttcacaaccctgtcctccacaatcctcctagcctctccagcctgcctgctggctgcctgctgctgctctctctgaactgagagagttaaccaagcgggccaggcagtctgggctgggggccgccccctggcccccctccagccccagctccagtttcagctgctggttggggagggcatgg

SEQ ID NO: 61027 - DNA, 460 bp, Homo sapiens
agaaactgggtggacgtattgtaacgcagtatagtgtacacaaaaccatactttaatatagagatttttttaaagggtaattttgactacacacaattttcatctttgctgattttaatataagccttttgtaagatgcaacccaagggtaatttcaaatagcagactgccctgttgaccagaatttgttagattgctattacaatgctgattatattttatagcaattactgacataaggttatactttgggcaatggctcatgcctgtaatcccagcactgaggccaaggtgggaggatcacttgaggtcaggagatcaggacatagtgagacctccatctctacaaaaaatttaaaaatcgaaacatatcgcttgagccccaggagttcaaggctgtagtaatctatgatcatgccactgcactccagcctggacaacaggacaagacctatctctt

SEQ ID NO: 61028 - DNA, 511 bp, Homo sapiens
cattcttacactttaacaagcattcatttttctaagcctaaaacttaggaacacaacttggtgtaaaataaagtatctgaagacagaagacatcctccagtattagagatttgggaattgtttctatagctgattgcgattgtgcctttattaacttcaggttcagagaggtttgcattttccttgtctttttccattccagccatagaacttctgagcttcagcagagtctgagttcccttgcaggggtgagtcatttcacctcccatcttttcttttgagagttcttgccaaccacctattaacgtcttcagccagttggatgtctagtcaaaatttaccctgtgctacacattgtttactcatttgtcatcattttactctagttttgtaaaattttatctccaagtttttaaaagtgaattcattgtctaacgggtgaaaaaagcagtcctaggtaatggtatgccattaacgtgttccacatggtgagcctctcaggtctgctgaa

SEQ ID NO: 61029 - DNA, 349 bp, Homo sapiens
gatctacagcaagcctatttattgctttcctctacagcatatttatgtaaaagagatgtataatcatctccagttactctcctatcattttatcttaaatcccatgtaatcagctcctgtactcaatactccatggaaattagtcatggcagagtaacaaatgctttccagattgctaaatccagtgcttagttctcgttcattttgtatcatgtgattttgagaccctactacagttatcttctagacactaggatctagcagtgaatgtaataggtaaaaatctagtgtagtttgtattctgatgcagggagatagatactaattagatacataaatagaatataag

SEQ ID NO: 61030 - DNA, 821 bp, Homo sapiens
aggcctgcttctggaatttcattagttagcactagaaacaaaatgcaagcctttagacttccatgttactggcagaaatggagaacggggcgaataggatattcagtgaagtggggtacataagaagttattcttccacagtacccccttttgctgctattagcaatattttagctctagattttcatctgcattcaattccttctgattttcagattttctttcacagtcttcacctaaatacacaatgtacaatatctgatattgtgataatcttttaagattacatccatacaacattttataagtattgccacaacatatatgcatttttcccagcaagcccacccctagcatctgtggggcctagggcaggactacaaatctctgtatgtctaaatatttaaaagcttacgaactgttacataaaatatttatatccacttacctggacaaatacaccttcataaaacagaattcaaaattatgtgtaaaactatggttttaatatagctgaaaattggcaaaatattaaagatagctaatttttattgtgtatctctaggtattatgttgatgggccactaatgcttggatgggtaataaagacatacataatcacataatccataaattatgttatttcttctataaatgtttctcttgtcttcatttcagaagaatgactaatgaagattttcacgcaattgcattcttttgacagtagtgccaaattagacaaactttcctgagtcagtatactttcagatagtttttagttatttcaattgggagaaacttgactctgctgagtggtaacg

SEQ ID NO: 61031 - DNA, 423 bp, Homo sapiens
atgaagatgaaaacctccacaccaaataagtggaaagaaaagttggaaagaggtggagagaatgactcaatctttgatgtatcagtgctgcattgcctccctcaaaatgtctcaactgttttatgcagctgagcaaattcgtgatctcaaacagcaactcaagcaactccaggaaagaaaaaaaattgaccactggaggagatacctaagataatcctggtgatactttcggtgctacaagaaaaaaataatcctcgcacccaagaagaaacaatgaaaccttatttttcatgtaaatttctactcctgtttggttcaagcatttgaactgttgcataagatttttttgagtgccgctgagaaaagtattatcaatctagaatgcaccagaaagaaagcagcagaaatattacaaacagcttt

SEQ ID NO: 61032 - DNA, 930 bp, Homo sapiens
atggaaccagagaatgacacagggatttcagaatttgttcttctgggactttctgaggaaccagaattgcagcccttcctctttgggctgtttctgtccatgtacctggtcactgtgctcgggaatctgctcatcatcctggccacaatctcagactcccacctccacacccccatgtacttcttcctctccaacctgtcctttgcagacatctgtttcatctccactacaatcccaaagatgctcattaacatccagacacagagcagagtcatcacctatgcaggctgcatcacccagatgtgcttttttgtactttttggagggttagacagcttactcctggctgtgatggcctatgatcggtttgtggccatctgtcatcctctgcactacacagtcatcatgaaccctcggctctgtggactcctggttctggcatcctggatgattgctgccctgaattccttgtcacaaagcttaatggtattgtggctgtccttctgcacagacttggaaatcccccactttttctgtgaacttaatcaggtcatccaccttgcctgttctgacacctttcttaatgacatggggatgtattttgcagcagggctgctggctggtggtccccttgtggggatcctttgctcttactctaagatagtttcctccatacgtgcaatctcatcagctcaggggaagtacaaggcattttccacctgtgcatcacacctctcagttgtctctttattttgttgtacgggcctaggtgtgtaccttacttctgctgcaacccacaactcacacacaagtgcaacagcctcagtgatgtacactgtggccacccccatgctgaacccctttatctacagtctgaggaataaagacataaagagggctctgaaaatgtccttcagaggaaagcaataa

SEQ ID NO: 61033 - DNA, 555 bp, Homo sapiens
caaatacattagcatatttgatatgtgcaggactagataccttgggacctgccacactccactttcaagatatgtattagcttcattagaattaaagggacttgaactcaggacctgcagcctattctttatccacatgtctctggtagggctacatccagatcacaccatgacttcttatagagcaagagaaaataatattattatatcttcctttgcctaaaatctctccacttattcttttttatgattctgcaccagttcactgggttattctatgattccatatttttttttaaaaaaatcatatttaaaatgaacttacaatgtctgaattttcctggccttgagtcacagaagtaatatgtttcagatggctgcccaatatgtattatcatgtaatacatatctgtgtccttttctgggatgaggaaggcttcaacttctggcactgagaactttgtattacagacacaggtttagtttctagcttagtcatgcctttagagtttagtagcacaaatccatgcaacccaacagaatacatggtgaggg

SEQ ID NO: 61034 - DNA, 1272 bp, Homo sapiens
  misc_feature (1267)..(1267): n is a, c, g, or t
  misc_feature (1269)..(1272): n is a, c, g, or t
ggtggtttcaaggctccaggcgccagcaaaagctctctactccctagaatgtctgtctcccaagacccaagaaagctgtgtctcatggaggaggctgttagtgaatttgagcctggaaaggccacgaagtcagagacccagcctcaagtttctgccactgttgtgctccttccagatgggcaagcatctgttgtgccccatgcttcagagaatttggcttctcaagtgccccagggccatctccagagcatgcctactgggaacatgcaggcttcccaggagctatgtgacctcatgtcagccagaaggagtaacatggggcacaaggagcccaggaacccaaactgtcaaggctcatgcaagagccaaagcccaatgtttccccctactcacaagagggagaactctaggaagcccaacttagaaaaacatgaagaaatgtttcaaggattgaggactcctcaacttaccccaggcaggaaaacagaagacacccgtcagaatgaaggcgtccagctactgccatcaaagaaacagcctccttcaataagccactttggagaaaacatcaagcaattttttcagacgattttttcaaagaaagaaaggaagccagcaccagtcactgctgagagccaaaaaacagtaaaaaacagatcatgcgtgtacggcagcagtgctgaagctgagaggctcatgacagcagttggacagatactggaggagaacatgtcactttgccatgcgcgccatgcctcgaaggtaaatcagcaaagacagcagtttcaagccccagtctgtgggtttccctgcaaccacagacacccgttctactcagaacacagcagaatgctgagctatgcagccagcagtcaacaagccactctcaagaaccagagtcgtcccaacagagacagacaaatcagagatcagtagcccttgaaaagtgtccggtgcaacaatgagcaatggggcctgcgacatccccaactcttgctccccaagaaagctgtatccccagtcagtccccctcagcaccggccgaagacacccagtgcctccagccaccatcaccactgaccaaggcactgtctttttcagggaggtatctaatttggtcagtcacaaattcctttttagccttccctagagaaaaacaagtcaccaagaaaaaattcactctatgtagaggaaaagtattttctctcatgttagtacacgcagaacatttaatattccacaatatatacggttttttattcaaaanannnn

SEQ ID NO: 61035 - DNA, 2244 bp, Homo sapiens
  misc_feature (411)..(411): n is a, c, g, or t
  misc_feature (627)..(627): n is a, c, g, or t
  misc_feature (793)..(793): n is a, c, g, or t
atgctcatactgggttttggggtgcccatgatatgtgtatatgtatatttcttttcttcatttttcaaagattatttcactttgccatagaaagaaatacaaagaacacaattgttggaaagtaataacaaagactggcaaagcgcattgtgatttttaaagcaactttgacatgaatttatgtgtttaatctttccaggagccatatggcacaaagggtattatttctcttgttttgcagttgaacaagggaaggtcagctcatttccccaacatcacacagctaatgagtaactgagccagaacttgaattcaggacctctcacatccagactctaccacatcaaattccctttccccagtggctctaactttgactctgttacatcctagaacatcacctctttaccngatatgaaagacaaccttttcacatagtttaggagttgactttctctgttcttaaagctgatctaacttgactagctgccttgtattacatattttctcccaaacacccctttctctaggacgaatccaaaatttggcaatcttgggagttagctatgtcatagtcagatctcttggaagacaaagagctccaggtctagagaagcaagtgggagngtgttttccaagtgtacttagaaaatgtttatgagctttgtcctcatctgaataatcagaagatatgatttgatttttacaccttggtatacacttggagattacacagtcctgaggtttatatattcctcagagccattagactgaccaaaagggttcgtccctntgtttcatagtatttttacagttctcacagcaatcacttatcagtatttaaattgaccttagctgggcacagtcactcacttctgtaatcccagtactttgggaagctgaggccagaagtttaagtccagcctggacaacatagcaagactgtttctacaaaaaaaaaataaaaaattagccaggtgtggtggcacacacctgtaattctagctacttgggaggctgaggagggagaattgcttgaggctaggaattcaaggttacagtggactatgattataacactccacttcagcttgggtgacagagcaagaccctgtctcttaaaaaagtaaaataaaataaattaatctttacaacaaccctccaaggtagaccagaaagaggtggtatccttattttattgatggtctgtgtgaggtcatacagacagtaggtggccaagcccagatgccaagcctaagcctcgttccttttgtttacccaaggttcctattcataccattatatgaccatttagccttaaataatctgttttaattgcaaattttattttaagaaaggaaaaaaatcacatttattctgctgcatcttcttgctttattcataatgaattctgcaggtcaatttatcctcaacgatggcaagccagaatttaagtaaagcttctacttagctggtacatttgcatgtcaaatctttaattcagctgtcagtgttttagcatttactgtactttcattaataaatgttattttgatggtctcaggctaatcaagactatttgaaatgggggacggcaccaaatgaaatttacagagaaatcagagcttcttcatggactttaaaataattgttactttacacgtgtttgaaatcagaatacttgtaaaattaaagttagacatgttgttcttgcataaacaagcaaaagaagctaaggaatcaacttagatttatttgttcctttaagagcatgtactgagcacctgctgtgtgctagacatgttgtagatagaggaaatgcggatatcaacatggcaggcaaaaataacctgccctcaagaatttccattctagagcgagtagacagatgatatctcagatagtgccagggcctatggaaaaagctgaccaggcagggcactgaattctggggagtgggtggtcagggaaggccttgcttccttctcatccacattctggcatagaagtttgatttccatgtacatgtttttttttgtaacatatagctccagaatacgttatttttaactttgcactcaataaaaaatcaacttgtagtaattaaacttgttcagtacattcttcacagggacattaggtgctactacttctatcagcaacaagtatatgcttatctattttttatacattggagtctacacaaggcttcctgctttttataaaaggaactgcctctacaaa

SEQ ID NO: 61036 - DNA, 485 bp, Homo sapiens
tcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaaaaaaaaaaaaaaaaaaaaaaaaaaaaaatttgggggcccccggggcccggagagaaagaattttaagaacacacaatgggggggggggggggcccaaggagggaaaggggaaaaggggcacaaagaaggggccccaagaggaaaaccggggacagaaacagggggggggattctcacccaatataaaaaaagaggcccgggggaaaccggggggtttggaaaaaactcccagggggagactcgggagagcaaaaagaggggaccataataagagagggaggcacaaaaggagaaccgaaaaaaaaaatttaagccccaacgggggtatc

SEQ ID NO: 61037 - DNA, 239 bp, Homo sapiens
tcagaaggtgtgacaggttttccctatttatcattaccaataataacaagtattgagagttttaaaatttctcccagaagataaactaacaaggatggaaggggagggcaaaggatatctaaacatgagaataaggacatgttagagggggggaaacagttgtaacaataaggaaagagaagagcaacagtggaagagacaggttgtgtgcccctaaagattctgcacccccagtttgg

SEQ ID NO: 61038 - DNA, 754 bp, Homo sapiens
aaaggataatcttttacaaagcagacagaatttttgtgtataaactgctctgtttgaatgcctcattgatataccatctaaaaactgaagtgttcagcaagattagcaaagccctgagctattgagatgggggaaaacatgagaaccaggctcttctctataggaggcaaaggtgacggaagatgcctttgctttcgcagtagtagcaaaaacagagccactgcccccaccgggccccgatagacctagttgcttggaaatgaaaggggcacaaagcaagctgcttgaagttgctgaggaaaaggtgaagagtgtggtcgtatgacttctttcctagaattttctttagaaaatggccctgactctacaaacactgaatttacatggtaggtcccccacttgagcctaacctcttttaaactttccatgaagtatcccacacgctgttgcctcagttgttccattgatgttacattacttgtgtcattcctagtctgccctatggaaaaggcagtactatagaaaccaagcaaagatccaaagaaggaggatggtctctttctgccatctgcattttctctttccaaggatcaggagctcccccaaacagctctcttttgcagagaggagatagagatcacttcattctacaatggacaaagaagggtactttgtggaattttgcatggcctggggtcccagatatgccaccgattaaaaaacttaacagatggactctgagaataggaatatg

SEQ ID NO: 61039 - DNA, 536 bp, Homo sapiens
gcctcggtaatgccgggcgaccctccacctaccaagctctatcatttcaggtcaacttcagactgctgtgctggcagtgagaatttcaagccaatggttcttaggtttctgggatgtgtgggagtgggacccactaagcgagaccacttggctccctggcttcagccccctttccaggggagtgaacggttccatctcactggggttccaggtgccactgggaggaagaaacttaaggcccaacaaatttatgcattgagccaaggacaagaaagaaatagcagaacaagatctaaaagacaaattccttcgacttcagaattcatgacttttctactagcccaggttacattttgtttaactgccaaatcacagtgcatttgatgtcacagatgttgtgctctcattttgcagccttctgtcctcaggaagactcaggcagcatgttcctctgttattgaacgtacacaatattgtaattaattgtttacctatctggcactcccaataaactgtacttcttatgcataagaaca

SEQ ID NO: 61040 - DNA, 182 bp, Homo sapiens
ttaacacaaaaaataccaaatactggtaagagctgtcattttggttttctttagacatgataaattacatttgcaaattagtgtctgatctgagatgacatggaacaaatggtaatatttacattctgcacattatccttgtcagattaagctgcagttggccagtgtggatataaagaggc

SEQ ID NO: 61041 - DNA, 761 bp, Homo sapiens
  misc_feature (641)..(641): n is a, c, g, or t
caactttctcacttagttctctaagatagtgaggatctgtctgctttcttcttgaccattagtggataggaaaaaaatgctctgattttctgtaaccatttgtcaccaaggccataaagacattgaactaatttccttattggagttcattattggaagtcttgaggagtttacacatttatctacaaagtaagtaggccagctcatttgtcttggctcatgtgtaatctttaaagcatattgaaaaattactattctcaagtaaggataatgtatatctcaggtcacttacagtctcaaagttttgtcagtatactttaaaacaatcctgcgaacagatctagattgaaggagactaaagaatcatgaactcgaggtggccccggggcaggcgcagagctggcaagcacgtggtggggcccctgaggcgtgcagagggtcacgcacctgggagcctgttgctggcacggtccgggcggaggttctgcggcgggaggcagcctgtcggttgcagggctgaaaaagcagttctacaaggcaagccagctggtcagtgagaaggtcggaggggctgaggggaccaagctggacgatgacttcaaagagatggagatgtcatcagcaaggcggtgacggaaatnctggcaaggaccatcaagtacctgcagcccaacccagcctcacaggctaagctgaccatgctcaacacagtgtgcaagatccagggccaggtgaagaaccccggctacccgcagttggag

SEQ ID NO: 61042 - DNA, 1975 bp, Homo sapiens
gacaggacctgggaatctttgtctctctaaaggtcctgttctttcaccattcttctttatagccatacatgtacctaacatttaatctagtttttgtggttggcactagaagcctaaccgtctgtaacatttacatgggaaatgtttttgccatgggaaatgcattgagtattccaacaaattcatttactgataaacttttgaacctccttccttgttaaagttggtgactaatatttgatgcttttttaggttgagattattttatatatttaattatattttgccatgcaaaacatccaaataaatgtttagattgtgttcttgttcttttggaagctatatttcttcaaaacaaattattaaatagttttggaatgtgggatgttataattgcttattagtgacatcatccatccatggcccagtaaacacaacattctctctctttttttttttccaaattattgtgtttcatagcaattctcgtaaactttaacaaaatatgcttctcataaaccttaacaaaatatacttccccaaattcaagctaaaatgattaattttataatttcagtatctaataccgaaaataaccttttcccaattggaagatagttgtatgtttgggctaagtcacagagcctcttagatctggcctaccagatctaaatttcatctgatccacagttctggtgatgaaatatcactcagccctacccgctgttgaatggctgtgttgcagggaacttgtgatcacagagccaccaggcaggcacacatgctgccagatgcctatgcagggagcaccgctccagccacctgctttggtccagaggctcgcagaaaaacagcatcatagcttttgtttctctgacggactaattttttggatttgagtgtctatgtcgactggtcagaggaagaagagtcagaaaaacagcctgagcttcggtttaaaaactgtacagttttcacaacagtgccagtctgatgtatgctcaccgcagaacatgcagcatggcctgtgcttccttcctctccggggcacacctgctattcctcaatgactctctactaagggccaccccccaacctgcccccgaccaccgacctctgtcctcccaagtggcctgtgcggcactttagtaggccaaacaagctgagaagtcacgtggctttggtgtcataattctgtgtgtgaacttcattttttgttgctgtttattatatgcttttatttgtatttgccagggcaatactgagaaaaagaaaagaaattccctgaaatatgttaacctatcataggtatagaaactatagctaacaaattattttgtggggagtggggaaaggagacctctttcagttcaaaaatctggtatttatttcccaacttgttaaaacaaccacagagtccaaaatatattattaatttataggtactattttctgtaggcctcttgaagggccgttttacagtagtgtactggagaagctcttactgaagagcattttgtcaatactcagtgtctacagagggtgctgtctgagtgttgagaatgacaaaggaagcaactgacatggtctttgaccttgaattgtgtccctttcaacccaaaacaggacaggcagaagtattagagtagttgatgattcaattaactagatcttagctgactgatctcagaaggtttcatgaaagaagtgagaacaaatgctttaaacatcttgatctagcagaaagaaaagtgtctctaaattggtgagatgttatctgtggagacaaatgtaggatttagagagagagatgcaaaaggggaagtaagagggtttattcaagagagattatgactgggtgcagtggctcttgcctgtaacctagcactttgggatgccaagacgggcagatcgcttgagctcaggagttcgagaccagccagggcaacatagtgagacctccacctcaaaaaaa

SEQ ID NO: 61043 - DNA, 2860 bp, Homo sapiens
catttgtattcagcatgctaatgatgtaactcctctctttatcattaccacggtgatagttaagttcattcgttaactcattttagtgacatgtgaggccatttaaatatttttaagataatgtatattgattagaaagggttagaaggagacaaatttatggtagaaattagccttgccattgtctaagttaatttatgtgacctgattgaacagttttagttgtaactttagagtagcttctttgttagaggatctctttcctttctcttttggttttctcccaatatttttatctgtcttgggattatcttaaaaggtatttattaatgagtatttggaagaaaattgacctagaaaatgtctcttttaaatttatctaggtacttgtatcaccagagaccttcatcaagtcctactgccacactggataaggccactacccccgacccttcttgtcagggacatggcttcctaataatggttttgctgttgtctctacataggggacctatggaaaaggagtttgaaatttctacctttgtagtacattgtatccaattttgttttgctcctccttttcatgtggtcaccaagcttttttccttagccattaaaaaagccacccctctttaaaacaaatttaaagatctatatacatttttgcaactttatttaataaaaaagagaagaaaaaaataaaatctaaatctcaattaccctaaagtggaaaaacctaagtatctaacctaggaacttgttgcctggtggtggttgttgttgttgttgttttttaatttatttagtgttgatccttgagttatttaatggtatccaaatgatatctgaaagtgattgattttaagatgtaatagttggcaaagtcatttcatttgtgtctcaaacaaataaagcccactgccatgggttaccatctgaaccctgattcattaggcactagtcatgccaaatggggatctcagaatagtttaatcttttcaaagatactcacaatggccaactgtgtgtgaatactggaaagtttgagattcttctatattcttcaaatttatggtcctgagactaggagggatctccagaggtcatatggctcatcgatctaccaccagggaagactgtcacttaggcatgcccaacaggagagatcgccatctattcttaacatctctagggaaggcagtttccttggcaacacaattcagctctcttaggttttctcacaataagaaaatatcttggccagtctttgagggttaggcacctggcaacagttgtggtgatttgggccattgtactaggggattcaagggaagttgggtttccccctacatttggtgattattacattaatatatgatcattccataagtctcctaagaaatcagatttttaaagaaagacacggattcagagacaatggtctgtaacatgaccaacttttgacaaatatggctgtactaggttttcatttttgctgttgttgttgtttgtttttgtgattgctcttatgtcggtaggtaatgtcaggaaaagtgactgtttcagatccccagtacaaacatcagaactaggatcaaatgacttgacttttaagctgttccattttctaagaagttacaattacaaaaagtaagcattttctacattcttacttctaagtaatgaccttctcattaatctttccttggcttaaaatgacaaataagaatccaaagtttttccactcctcctgtgggagataggaatagttgtgaagagtctgatggaataaaatgactccagagatttacacagccaccatttgatcccagcctttgtccttgtgttatttaaacaatggcttcctgctttctcaggggtcaggaaaatgatttaaaaatttgtcttcttgacaaggcctgaaaacgaagggaggtgtcgtggagaaatggtgatttttctggttacatcacttgattcaagcactccctggagctttcaaagccttttttatctgctcagagttgacacccaactcagagtcagaactcaccagaagatgaggaacacccccgaaatcaatgtttcctttctccatgggatttttttcaatcttggtacagctgcatatctcccaaactcggatgctcttgtgaaatgacagccacatcagtgtggttactccccacaaataacactagggggaaatgaccttttttatttaaaaaaaaaaaaaaggctaatgctatagaatgatcatgtaaagaatgttgaataaaatttggcccatgttttaattgactctaggcacctctattgaaataagtctgaggcatagtttgtgaaacatgtttcaaaagtgtttgatgtataataaatgctagaaatttacagtacagaaatagtaaaaaaataaaataaaaataaacctgtagattacagctctgttcctaagaacctcagcctttattgtgtcttagtaaagttgatctgctttatttttagtttattgaatttctggtgtactagcctcttaagatagaacttttaatacatatgtactggttaatgcctgtttacgcagaaaatggcactttgttctttcagtgtgtttccctcagtgtcacagggtatatcaatttgatagatcatttgacatttgtcaaaaatacgtttcccattttaaaaatatgtataattggttgcatagacatatgtcactttttgcagtgtcttcatcttgatcatagttttagacatcaactatgtctcactttccaactgccatagaaatttggtacatttgcaaattctggtggaatctagtgagctgaatgtattggtagatcaaatgatccaa

SEQ ID NO: 61044 - DNA, 1370 bp, Homo sapiens
cggccgccgccgttccctgttgtcccgatcgcttctcacccccgccgccgcccgcacgcggagctcccccggtgaggtgggaagacggagaatcagggataggatcaaatgacttgacttttaagctgttccattttctaagaagttacaattacaaaaagtaagcattttctacattcttacttctaagtaatgaccttctcattaatctttccttggcttaaaatgacaaataagaatccaaagtttttccactcctcctgtgggagataggaatagttgtgaagagtctgatggaataaaatgactccagagatttacacagccaccatttgatcccagcctttgtccttgtgttatttaaacaatggcttcctgctttctcaggggtcaggaaaatgatttaaaaatttgtcttcttgacaaggcctgaaaacgaagggaggtgtcgtggagaaatggtgatttttctggttacatcacttgattcaagcactccctggagctttcaaagccttttttatctgctcagagttgacacccaactcagagtcagaactcaccagaagatgaggaacacccccgaaatcaatgtttcctttctccatgggatttttttcaatcttggtacagctgcatatctcccaaactcggatgctcttgtgaaatgacagccacatcagtgtggttactccccacaaataacactagggggaaatgaccttttttatttaaaaaaaaaaaaaaggctaatgctatagaatgatcatgtaaagaatgttgaataaaatttggcccatgttttaattgactctaggcacctctattgaaataagtctgaggcatagtttgtgaaacatgtttcaaaagtgtttgatgtataataaatgctagaaatttacagtacagaaatagtaaaaaaataaaataaaaataaacctgtagattacagctctgttcctaagaacctcagcctttattgtgtcttagtaaagttgatctgctttatttttagtttattgaatttctggtgtactagcctcttaagatagaacttttaatacatatgtactggttaatgcctgtttacgcagaaaatggcactttgttctttcagtgtgtttccctcagtgtcacagggtatatcaatttgatagatcatttgacatttgtcaaaaatacgtttcccattttaaaaatatgtataattggttgcatagacatatgtcactttttgcagtgtcttcatcttgatcatagttttagacatcaactatgtctcactttccaactgccatagaaatttggtacatttgcaaattctggtggaatctagtgagctgaatgtattggtagatcaaatgatccaa

SEQ ID NO: 61045 - DNA, 442 bp, Homo sapiens
aaacgggccgcgaaccgcagtatcatgctggccaagaagatcatcattaaggacggaggcacgcctcaaggaataggttctcctagtgtctatcacgcagttatcgtcatctttttggagttttttgcttggggactattgacagcacccaccttggtggtattacatgaaacctttcctaaacatacagtgtgtaacagttctaatacagcaaatttaatacaattttttattagatcaaaattcaatagaatgtttcatatgttttaaggaaggttcattgaatttcttcttttcaatggaagtcttcatttggaaaaatgccttttatccttcttgccgtttactcaatgcttgtttatatatttgtgttgactatcagagacactttttgtttgtgaatttagtaaaccatattcaaaacagtcacgattgactctgc

SEQ ID NO: 61046 - DNA, 626 bp, Homo sapiens
  misc_feature (47)..(47): n is a, c, g, or t
aaagccaaatgggaagcatggaacctcaaaaaagggttgtcgacggnatatgcgacaaatcctattgtgaactgtgcatgcaagggatctaggttttgcctccttatgagaaactaatgcctgatgatcttctgaggtggaacagtttcatccagaaaccacccctgcctcctccccatcccctcgtccatggaaaaattatctcccattaaactggtccctagtgccaaaaagtctggagaccactgccataaactacacaacaataagataaaatgtaattatgaattacatttgaattaaattttagaagagaagacacatactcttagaaagtgcttcaagtaatctagggtagacttaaatttcaagaacaacccatcaggacagtgactaactagattatatctacaacagcttcaggtgaactcagccctaagcaaaactgtgacataaaaaaatatattataattcatgccactccctttctttagcaagtaccttggcctttttttccaattttatttatttattttattttaaattgatagacaaaattatatatatttattgtttcttaaatttatttttaattgacaaataaaattgtatgtatttatggtgta

SEQ ID NO: 61047 - DNA, 452 bp, Homo sapiens
cagagaagaaaaatcacaccagtagaaaaacccacggatgaacgtcatcatactcagtgtttatttattttagataatagtttgtgcactaagaaaaaaattaagatgttttatttctctttctagaaagaaaaaagcagacataaacattttttgaagggactgaaagtatctcactaaataaaatatggcaagcctgtgaccaaatctatgatgaaagagcaaaaagagtatcaaaatcatacagggttttcttctataggaaatccagactgcgagtcattaagccctacacatttaccccaaaaattcagttctgtggcacagaatttggaataattatacaaaattataggtagatttggggcaagaataatctcatcaattttcaatgtcactgccacagcacaaagcaaaagtagagaaaaacttgagaattgcacatactttgt

SEQ ID NO: 61048 - DNA, 327 bp, Homo sapiens
ctacaatggcaggaactagggcttccacaagtgccagagattacaggagactgggttttataggtttgaagagcagaaagccaaaacgggagggaaggggggtagtgaggtgcacagtcctttgtggctcagatgacagatgcggccttcgtggcctgacactttccaccaccgtctgattttgtgaagtgatgaacacgggtaacgtaaatactggtgttagatttatactgacagccgctctgctcatcaagagtgcagtgatttcctgggaacttagggggtgtcagggaataaggtgaaacaaaattcccccaagttctgtcc

SEQ ID NO: 61049 - DNA, 492 bp, Homo sapiens
tcagcccatgaagtagaggcacccaggtcctgtgcctgtggctatagcacactttctgcccacccctcggttctgaccaagggcatttgtccccactaaagattatatcacaggtctcagttgggagcttctctcaacctgtgaccactgcctcagttaaccagcagacttcaggtgaggtcccctgtgaggtaggatcaggaatggcttccctctgtccctgcttggttctgggagtaaacacggttcgatgctgctccttttcataaaacctcactgctcactaagtagcaccagcgctaggtagggttaaggtgttcccctgtggcctggattgctcggctccccagtgggagagtgtatcatggaggcagtctctcctccccactcatgctctggcaactcccagttttcctcctggtttatcatgtagactactgcccactgcttctttcaaagggtttgtggtttctttcagtgttttttaagttc

SEQ ID NO: 61050 - DNA, 441 bp, Homo sapiens
taacttatcttgctgttcttctgtttcactagaagaagctttttccagcattctgactggaaaacttcttagccaaaaccataagttcctgaagtgccctttatatagcccatgttattgcagacaatgctggttgttttgccaaaataacttgttttctttttttttccagcctgtaataatatttcttcactgtactttaagctttcactaagagtctgtgcttgtgtcttgtcccaaaactcaacagttgatgtcttaggttttagttgtccagcaacccacctctaggcccaacatcaatggttaaaaaagaggatagaagcatgaaagcaaaaaaagaaattactgtgaaaaaatatatacacaattcactatataaattttaaagccttataatatcaacctctctcactgtaagtaaagctaaagtcagtaagc

SEQ ID NO: 61051 - DNA, 892 bp, Homo sapiens
attgtgataggagggatttactctttggcagatatccaagcgtggaaggcctgtttgatggactgtccttgataatcacaggcaggtatagcctcaaggctttgaggatggctctaaagtacatttcaaacaccacctcctccacaaagcctttctactacaactccatcccctgagtagagtgaatctcttcatattcttagtacctacagaattttggaatagtcatgtttagtatattttgttttagcaaatagggaagcaaatactatattttagaaatagttaatgtaaaatggctaggttttttttttttttttttctttttagtgtgatgcttcaaggggagcctttgtcattgtattagtccaggacctcttagaagcagatgccaagatgggattaagcacataagaaatttgttaggtgaaatgcttgtgaggggggaaaaggaaggagacagggagagttgtcagactgatgaaagtctgactccaagttaaaagagaggtaaggaaggaaggaactttgagtgaaagtgtcttagactgtagtgcaatactaaggaaagtttgcaaggcctcagaaagtctttgagtgaaaggtgcctgttggaaaaatgatgtgtctcccgggaacaggcctgccatgctcagtcagtgactgggaggagctagtgagaaactggcctcgacacaaacacagtgatggatttgagtgcagctgctgcagcactcagtctattatccttcctgtagtcagagatctgagaggctcgttctcatgatcaattagggtcatctctggctatgaattgcctaattcgggataaagtacagtttttccccatttcaggtgggtaatttgttcccaaaaaacccctgtatttaaa

SEQ ID NO: 61052 - DNA, 1115 bp, Homo sapiens
gtcagcctgggcaatctcagcgacaacaaaaggtacagtctctagagtccaactgggttcaaatcctggctctgtcacatactagctgtgtgaccttggccaagtttcttaacctctctgtgtgtatagtccttatctgaaaatggggataaccaaccaagagagctgagagaatatgagtaaagtgctaaaaacactaccaagaacacaataaatgctcagttaattttgggggtgagggtcatataacctagcccaaactgtcgatagcaaaataaaacaagttaggagcagtggctcacacctgtaatcccagcacttgcgggaggattgcttgagcccaggagtttgagaccagcctaggcaacatagcaaaaccgctatctctacaaaaacaatttaaaaattagccaggtgtggtgaggaacacttgtagtcacagccactcagaaggctaaggagggaggattccttgggttcaggaggtcaaggctgcagcaagccatgatcataccactacactccaatctggacagctgagtgaaaccctgtctcctcaaaaaagaaaaagaaaaaaaaagaaagaataagaaaactcacaaaatcagagaacttctccccttctagccaggcatggtggcatctacctgtagtccaactatgcaggaggatcacttgagcctaggagttcaagtctagcctgggcaacatagtaagaccctgtctccctaacaatttaaagattttaaaatgtttaatctttttttaaaaaattgctttggaacttttcccagttacctttacttgtagaaaaagtcttcagttgaggaatatatgcaaatactcttttataagaatttttattaaagacaatgttgatccaaagacccctccccaatcaagtcatcatagacctgtcttaatatgcagttgtagtagcaaataattcctggttctaaggagattgatgttgctaatctctaacaaccataaagtgaatgtacttctacctgatctttaaaatgattattcaattttagatttaaaacatcatttcaatcattgtaaatgaaatattttgatttaaaatccattatttgataatacaagtaaca

SEQ ID NO: 61053 - DNA, 557 bp, Homo sapiens
tgctcttttggggtctttgctcttttggggtctttgctcttttggggtctttgcttaaaacagaagcctggccatgtttgtgtaaagcagctatgctgtgcccagacttttttttaagtcagtgcctgtttttgttcctcctgactagataagacttctcaacttgtctccagtcacatcttataggtgtgttcatactggcaacaagttcgtacctcagtggcacagagctcccagaggaaggggcaggctatcatcttccctggaaaatacaaggcaattagggactggaggggacccccagcataccacagcagcctgacagaaaagtggccagacagtctacttgatgggcaggtcctactgacctgggtctccagccagtccaccatcagagctatccagccagtagcaactcagcaattccctggacagagcttccaggagcaaacgaaattctctctgccattgcctctgcagtgaaactgccctttctaccctcagaatatcaagggagcaaagaccctaagtgccatattgacacctccaataagctg

SEQ ID NO: 61054 - DNA, 191 bp, Homo sapiens
caactatctaggtctggtcaactaagacctatttttgccagatcttcaagtctgggcacagtgtaacaccagcactttgagaggccaaggcaggaggatcacttgagctcaggagttcgaaaccagcctggataacttagtgagaccctgtctctacaaaaaattaaaaattttttgcactccagcctggg

SEQ ID NO: 61055 - DNA, 392 bp, Homo sapiens
tcattcaaagatgcagaataccacacttgttttaatctgatattctttccatttctatccgtctaggacgtaattgcacacgggcgcctcccatcatttggttgctaaggagacagaaggctggtgtttccgatttgccactattacacagcggcccgcgagaagcatctcttggctcgaagcgcgctgtaggtgaaccgcccttgacttaaacgccaacacatctaaaagggggcgagggacgctttattttcatttccctgaccactactgaggtgagcatttctttcactcgcgtacttgtttgtattttttctgttgttcacgtccaatagaacactggttttctattggaggcttttgggtttttttcccccatttccctttcgtta

SEQ ID NO: 61056 - DNA, 354 bp, Homo sapiens
atggatgagtgggcaccccgcacagggctgcagggtggaaaacgctcgacggccaggtggtgacttgggggcagagagcgcagtgtgtaggggaggagaggtggtgtccctgctgcctgggagccagcctgcctgtgctgtgggcagagccaaggcactttctgctgccggtgcttccagggcctaagcagccgctgcacactcaccagcgcaaggctcctctgcagggaacgagggctgctacccatttcacagatgagggcaagcaaggacttgcccagggttgcccagagcaagtgcgtaacaggccctgagaagagggccagtgagctcatcctgagttaattatgggct

SEQ ID NO: 61057 - DNA, 395 bp, Homo sapiens
acgtacttcagtgttcattattaaaactaccgcaatactatatcataaaaatctgggatggatgttccagccatcataaggtccaaaagaaaagagaaagtgttattttcctgttagtgacatgtagtccctttgttctagtaggaaaaaaggtgcctagaggtagtatatagagtaaatattgttcctttagcctacttcctgcagcttccaatttatccaaggaaatgtctacaacaattttgttcaaaagtctgttctagtcaatagcaggagaagtccacgttattgggctgattttgcttacatcagcaagagaaatgtcacgtgatactcaggccgcgctttctcttccatcacaccatcttcaaggaatgtcaataaactcactttgg

SEQ ID NO: 61058 - DNA, 395 bp, Homo sapiens
atacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcactgagctttgtagattgttgtcctcttggtagagtcggggcctaaacaccacctgggcctctgtgccagtgggacaggtgacctgcctgtcctactgctggtctctgcagctctctgtcttggggcaaccctggctctgagttccagagtgttctccagtaggagagtctgcagggggcactgtggagcacctgggtatgtgcacatctgttgttggctgg

SEQ ID NO: 61059 - DNA, 218 bp, Homo sapiens
gagatacacataaaactatattatgaactgggatcacccaaattatcttctgcaggacattattctactagaaaatatggacaaaatcataaggaccaaaattttgtaaaattccttatattaaaaccactcttcactattagcaggagactacacatgttctaatggtctgagaaatactgcagtaaataaatctggttaattttgtttaaaccaaa

SEQ ID NO: 61060 - DNA, 238 bp, Homo sapiens
gagatacacataaaactatattatgaactgggatcacccaaattatcttctgcaggacattattctactagaaaatatggacaaaatcataaggacaattgtcagtttgatgctgacaaaattttgtaaaattccttatattaaaaccactcttcactattagcaggagactacacatgttctaatggtctgagaaatactgcagtaaataaatctggttaattttgtttaaaccaaa

SEQ ID NO: 61061 - DNA, 874 bp, Homo sapiens
tcctgcaggtgttctcaggagaagcaaggactgggtgagaaatccagctcagcacttatgagtctgccactcagcacacgcccgtatcaatcggccatgaccaaccatgaatcgctgcagagtccctgtccacatcttctgcctcagtttcctctctgcccagccagtcctcaccctactgcaccctggcttccaccttcactcctccacaaaatgcctctacttaatggattatttcctttgggatgcatctggaaggcaaagcctccttttgaaagctgtctccctctcacctgggtcacatggaggtagagctgaccccgagaagggtccaccacttctaagttgaagcatcatcaagctgaggagggcagcaggaagaggctggctcagacagggaggaagggtaaggtttgctcacaagcactaggaggagcagggaggaaacggctactcccggtggctgggagtagatcaaccacaacatcacaggagaggaaggcagaggccaatgggacttaacccccaagaggagtcacttcaagaatgccagtgaagacattacttgtagctcctttcaaagccattctcagaggtgttaaatcagcaaagtcaatgaaacaaagacagaggtgaccgacatgagatgcagttaatggagatgagctttttagaacacaggctcacgaactggtttgaaatggccagtgagatgcagaggcacaggagtcatgtgtatggccccagggtgtggcagggtcagcagagtgatcacaaggatgggaagagagaagcccggataaacacgaaggcaacgccagctttcatcttaccacttcgtcctcggaaggcttgaaaacacaaatttacactt

SEQ ID NO: 61062 - DNA, 685 bp, Homo sapiens
ctgggctccaggctgagggtccttggacagacgtcatctccctggcttcagcagaatcacccacaaacccaccctgtgcccaccctcccatcacagagagcagctgctggagaaggcagcatgagactttgaagacctcgaggagcaggagacacaggagacaatggccaggatggtcatggtggcgcggctatgccatcactgatttctgcctacctgccccctaagtctcacttgctactactctcaatttcctacttaatgcttcggagagcaccagtcctgagaagagaggcgggatgttcactctctgggagttgagatggaacccaggcagttagaaaaagtgccacagccacgtgccgagcctactacttgtcaggagctcagtgagtcatccaattcctaaaacaactgtgctgcatgtgctccaccgcgcctgggcgactcggggaaatgggctgcgggaggctcagtgacctgccctgggtgacatggatggcatggatgccctgtccatgcacggggctttgctaggagaggacaggatcatccccagaagctggtcctgtgtccactgctcacggtggcagctgcttgggctgacaacgccccccacctcctgatcagatagtgatatacttggtccaaacttcgaaagtaaaaaagttaaaacagaaaaaaa

SEQ ID NO: 61063 - DNA, 254 bp, Homo sapiens
atttttcttctgaattattttttttaacattctgtgacagagtcataggatcactaaaacaagactgttaaaaataaaaggttcatgaaagatcacctagttccattttctcatttatcatatgacaaaactgaggcccaacaggttacgtgacttatcctcctcagagcaaagccaagcggaggaggaaacaaaaaatcccagatcttgaatcagggtgcttgtcattgttgtcatttgtagaggtattgttt

SEQ ID NO: 61064 - DNA, 551 bp, Homo sapiens
caatcatatttgggaggttttagcatatctttctctgaaaatgatggaacaaattgggagggatgtagaagattcgaacaaactccttaacaaaattggcctgattgaggcccgtataggacagtacaccatggggccgggtgcggtggctcacacatgtaatcccagcactttgggaggccgaggcggatggatcacttgaggccaggagttccagaccagcctggccaacacagtgaaactctgtctctacaaaaaatacaaaaattagctgggcatggtagcatgcacctgtaatcccagctacttgggaggctgagacacgagaatcgcttgaacccgggaggcagaggttgcagtgagctgagatcatgcaactgcactgcagcctgtgtaaagagtgaaactccatctcaaacaagcaaacaaaaactgtgtgccatgggactgcttaatatacattctcttcaagcatacacaggacatttacaaaaattgaccatatattaagccctacagtaagtgtaaataaatttaaaatattgaaatta

SEQ ID NO: 61065 - DNA, 1025 bp, Homo sapiens
tcatccttcaccaaaaacgttccaaaattttcttcccagccctaatgtgagtcctgtccctggcttgatttccaactccagaagtgaaagagaaggctggttagcagttttcactgattcattcataattaatgcagcaaataccatttgagcacctacagtgtcagccactgagatgagttttctttggtaggtttagttaaaagggttagaaaacatacagcagataagatggttgtatgagttctgaatacattatttcccttatttaatacatgaaatatggataacacttagaaagcagctatacagtttgttaagataaagttatatttggttcctttctcctctcttccctccctcccctccaactgtggagccatgaattagaatcttataaatgaagctactttttgattgttagtcttttttccaaattgacaattttttccaaattgacatattataatgttttaaatggattttcttaattttgatagtctttctttatataaacacgtgttttgttattaaaattttaatttcccacaagcttttaaaaaatacttcaccattttcaattagaaaatttctaagtgtaattaattgcttctaaaccttccaaagaagaaaaatggtgtgtatttaataagtaaatcagctgaaaactaaaactgaaatttctataatttgaatgactgaagtagtcatttttgaaagaaaaaaatgcctaagttgaagattccaagtaaatgtataggtgggataagaatacataacaaatgtattgttattcattatttaaaatgagttcatatttgtatcattgaaagtttgatgcatttgggaggatgacgtcagcaagagaaagttcatttggtgtgacgttaacatttcagaaaatatgtcaagtaagagcaggttgatgttatactttcgtccttacagaccttctttctttctattgtgccatctgtctgtttttctgtattgtaaagttccaaataaagtattaatgtattatc

SEQ ID NO: 61066 - DNA, 486 bp, Homo sapiens
atggattaaagacttaaatgtaagatctgaaattataaaactctttggtatgggtcagatgtttgttcccttcaaatctcttgttgaaatgtgattcccagtgttggaggtgggtcttggtgggagataattggattatgggggcagatccctcatgaatgatgtagcaccatccctttagtgataagtgagttcttgcttggttcacgtgagaactggttgtttaaaattagtctgggagcccccccaccatgtgacatgctggctccacttctgccatgattacacctcaccagaagtacgtgccagcactgtgctttgtgtaaagcctgcagaaccaagagccgattaaacctcttttctttataaattacccagcctcaggtattccttcatacgatcataagaatggactgatacactcctagaagaaaacataggggaaaaagctccttgattctggtcttgacaatggtttttataaat

SEQ ID NO: 61067 - DNA, 233 bp, Homo sapiens
gttgatagtgggggaagctatgcctgtgtggggaaaacggggtatatgggaaatttctgaactttctgctcaattttgcttatgaatctaaaactgctctcaaaaaataaagtttattaattaaaaaaattaacttgagccatattggccagtgccactgtagctgatttatttctttttgcaattcaaacaaatccattaagggcataagttcaagatgaatgaatgccacc

SEQ ID NO: 61068 - DNA, 312 bp, Homo sapiens
agctcactacaacctctgcctcctaggttcaagcgattcttgtgcctcagcctcctgagtagctgggattacaggcgcccgccaccatgcccggctaatttttgtatttttagtagagatggggttttgccatgctggccaggctggcctccaactcctgacctcaagtgattagccaaccttggcctcccaaagtgctgggattacaggtgtgagccactgcgcctggccaggagtttaataaatatttgagtgaaagtaagtttcttgaccttgacgcatgggccctagagagctagaagacctgaattc

SEQ ID NO: 61069 - DNA, 305 bp, Homo sapiens
gtagagaggcagtctgggaatgagtagacctgattttaaacctccaattcaccatgctattgacgtaaatgttggtcttcactttactcattttctcaacagagatcatgtcatcctgaattataaaacatgcctggcccatctctccaggctgctgggagaataagaatagagagcccagtgtagtacaagcccagagagaacttcaagaatggtagctgtggtttgtgaattattagctactattcttaatagtgacacaaggacggaggcaggattcagttttcagaagcccacagttatag

SEQ ID NO: 61070 - DNA, 375 bp, Homo sapiens
cagcctggtgacagagtgagactccatctaaaaaaaaaaaaaaaagaaaaaaagaaaagaaaagaaagaaaagacctcctatgttagtttgtcacaaatctcctcagccttgatatctgatcaagttcctcatccctcactcttgatacctaagttcttggcctgctttcagcaagaattctgttaagttagtttacccttgagatctaatcaagctctttttagtaattttccccactgacccctcactctgcttgttggtataaaccctccaccatccctgctgagtttggaattggacccatctctttcccccgctgcaacagtctcagggaagccttcttgccatgtttagcaagtggccggtgcgtaatt

SEQ ID NO: 61071 - DNA, 481 bp, Homo sapiens
tgctttcctatccttctcttctgtttaaagaagtcggtgttagtacagcttgaaattcaatagggcttgaattacagaaggcacaactgaagttagagaagaaaggatttttgttctgaaaattagcggtgagacagaccactctgaataaatggtgatatctggaaataatttttgaaatgcccaaaatccttcgtaactttaagaaattgaaaaggggtggggagggtcgtctataagagtgtctgtcattagaataggacttcttaaagtaatgtttgttaacaattggtaacaaggtcatttccaaacatagttcctggagccagttggctttggattggtagaaaccattgttgttccttcagagtcctcatctttggtaatttattttagaacaaaagactgaagacagatgtccttgaacaaaaggtctgtcctctaatgggtgacagagcgagactccgtctcaagaaaaaaa

SEQ ID NO: 61072 - DNA, 337 bp, Homo sapiens
gtaattgctatttgatgttattttaagaaattaacccttaaaactttaattccttaaaacaatctcaaacagaagaagcaaaagcttgttctgtgctccaggaaataagattcagcaccaatgaaaataaattatagaaaatcagaagatgggtcaatatgagtggaaaaaacctaacattttaattgttttttctctcaataattgtgttgaaccatccaaaaaagtatgatacaaaaatagcactatactaagagccagatgacatgtccttaaagccttagctctgcaaattattggttgtgtaacactagaaacaacacttagcctctcctag

SEQ ID NO: 61073 - DNA, 428 bp, Homo sapiens
gattctgcttccctcagttttaaacacggctcttttcacagtttggacacagggtatatgagatctgtcacctggacccttgtgaagtgaccttttgtggtccataccacttcatttccagcatgcctatgtgttaatccgaggtcgactgcccaattcagtttgaattagattctagtcaggtaacacattggagaagctaatttaaaaaatttttaggagaatattttcttcctgttcccctgttgcattactacttatcctcaattcttgtggagatacaccttagtttacctctaagatgatccatgagatcacaatgacattatattctactctattgtgtaattctttaaactttcttaattcttacagtcaaagttacacttagaaagaatccgaagttctgtatatctaaaaactcaaat

SEQ ID NO: 61074 - DNA, 367 bp, Homo sapiens
gcattcaagacaatggcttggagaaagaggcttcagtggttcacaagtgactatggaacctctctgaagattcctaaagcttctgtgtgcatggacatgtttctgcccacagcaagattactgccccataggggcatctacttacttaagctgctcttgttattcaccgtgtaaaggaagttgtggccatcccctcttctttcttgcctatcattcagagcctagattttgttcaggacagtctaaccccaacaatggctcctgcttggccttaagcaattttgatgacccatttccctttgccaatgatagttcaaggatgtgcatgtgacccagttccagccaatgaggtgtgaggaaatgtctg

SEQ ID NO: 61075 - DNA, 102 bp, Homo sapiens
tccagctccacgaccctcacagaacaatcccttctcatgaaattcagcagtcaagaaatctgcagcggaagtaaatgaataaatgttttgttttcaaatcga

SEQ ID NO: 61076 - DNA, 322 bp, Homo sapiens
aaccagcttattagtttgaaaactggtaaataaagggaaaagaacatacattatatattatgcagaggaatgcaagatggtacaatcacgttggaaataatttttggcagtttctctcaaagttaaacgtactgttgacagacgaccagcaattccacttctaggttaccagaaaagattatccaagagaaataaaaacatctgggctgggcaggatagctcatgcctagaatcccagcactgaaggaggccgaggtaggcagatctcttcaggccaggagttcaagatcaacctgtgtgatatggtgaaaccccatctcta

SEQ ID NO: 61077 - DNA, 449 bp, Homo sapiens
gaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaa

SEQ ID NO: 61078 - DNA, 183 bp, Homo sapiens
aaaaaaagtaacgtgacttttttctccaacagtttgttttgtcctaaagctggtcaagtaacttgaatctcacctgtgatgagagctacattttaacatgggtttggttatgggaagaggcaagactttggtgggagaaacaggacaaagtgccattgaccttgagcggagttctctgtgaaa

SEQ ID NO: 61079 - DNA, 1090 bp, Homo sapiens
  misc_feature (167)..(167): n is a, c, g, or t
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatntaagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcaattccaaggccagcttggaatttaattctgtcttgataccttgttatttatgcaaaaactcctatctcctttcctttatgacaagagagtaagttttaggttgggatcca

SEQ ID NO: 61080 - DNA, 976 bp, Homo sapiens
  misc_feature (167)..(167): n is a, c, g, or t
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatntaagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatag

SEQ ID NO: 61081 - DNA, 547 bp, Homo sapiens
cagataaatgttacttacatatatatgtacatatatgtatgtatgtatgtatgtatgtgtacagacagatgtatttatacatgtataagctatctctaaaataatttggaagaaaagtagatatgcttccaagtgagcagaaaaatctctagacagatatacaagaaactattaatagtggtaaccccctaagagacttgacagatggctggagatcaggagtaggaaagagatgtaattttcacaatcatctgtgcttttcaaattattactatgtgcggccgggcggggtggctcacacctgtaatcccagcactttgggaggccaaggcgggtggatcaccaggtcaggagattgacaccatcctggctaacatggtgaaaccccgtctctactaaaaaaatacaaaaaattagccgggcgaggtggcatgcgcctgtagtcccagctactcgggaagctgaggcaggagaatggtgtgaacccgggaggcggagcttgcagtgagccgagatcgcgccactgcactccagcctgggcaacaga

SEQ ID NO: 61082 - DNA, 2147 bp, Homo sapiens
ttaggaagaagtgaatagaagaaaagagggtgttgcaaatcaaaagcacatagagatatcatcttacaccagtcagaatggctattcttaaaatgtcagacaacaacagatattggattaccacatcatcaggaccacaccttcatcaggaatgaatattcctactacaattaaagaagaaacaaaattaatttgttggtgaaaaacgtaaaaagagaaattttctttggttttgtttaatttctttattgagggtcaccactaaaaaaaatgctcactggtcattcttttgaatactgtctgagagaaagatgtaagatggttgattatttcaaatgacagaagataaagatgggatatcatcatggcatgaacaaaaacaagatttgtagctggaggtattttatagtctaacatgatcaccaatcattctataaacctgttggatgagtttatcagacagacagagagagagattgattgattctgaatagaaaatttcactttagaaaaaaatattttgactatataataatgtatgtaaaaattctctttgataagaaacgagtgaactggattcaattttcctcacagcctgtgtaatacaccatcacttgcttcctcctacatgccattgattagccccagggagcagtgcagcactgcctgcccatgttttacataacccctgaatataaatgccagatgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacggcctctggttaaatccctcccctcctgcttggcaacttcagctagctagatatatccatggtccagaaagcaaacataataaatttttatcttgaagtaattgaatgtttttccttaaagattcttttcctactcctttctctgttacttgtgtgtttcttttccttctagttctttaaggccaaaaactgatttgcctataagtttggggcagagagcagatgataaccaatattttatagacatttttgaggtgagagtaggtggagttttcagcctctagaggagaagcaagtgacatatttgttagtctgtctttagctcttccagaaa

SEQ ID NO: 61083 - DNA, 2093 bp, Homo sapiens
ttaggaagaagtgaatagaagaaaagagggtgttgcaaatcaaaagcacatagagatatcatcttacaccagtcagaatggctattcttaaaatgtcagacaacaacagatattggattaccacatcatcaggaccacaccttcatcaggaatgaatattcctactacaattaaagaagaaacaaaattaatttgttggtgaaaaacgtaaaaagagaaattttctttggttttgtttaatttctttattgagggtcaccactaaaaaaaatgctcactggtcattcttttgaatactgtctgagagaaagatgtaagatggttgattatttcaaatgacagaagataaagatgggatatcatcatggcatgaacaaaaacaagatttgtagctggaggtattttatagtctaacatgatcaccaatcattctataaacctgttggatgagtttatcagacagacagagagagagattgattgattctgaatagaaaatttcactttagaaaaaaatattttgactatataataatgtatgtaaaaattctctttgataagaaacgagtgaactggattcaattttcctcacagcctgtgtaatacaccatcacttgcttcctcctacatgccattgattagccccagggagcagtgcagcactgcctgcccatgttttacataacccctgaatataaatgccagatgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacggcctctggttaaatccctcccctcctgcttggcaacttcagctagctagatatatccatggtccagaaagcaaacataataaatttttatcttgaagtaattgaatgtttttccttaaagattcttttcctactcctttctctgttacttgtgtgtttcttttccttctagttctttaaggccaaaaactgatttgcctataagtttggggcagagagcagatgataaccaatattttatagacatttttgaggtgagagtaggtggagttttcagcctctagaggagaagcaagtgacatatttgttagtctgtctttagctcttccagaaa

SEQ ID NO: 61084 - DNA, 1649 bp, Homo sapiens
ttaggaagaagtgaatagaagaaaagagggtgttgcaaatcaaaagcacatagagatatcatcttacaccagtcagaatggctattcttaaaatgtcagacaacaacagatattggattaccacatcatcaggaccacaccttcatcaggaatgaatattcctactacaattaaagaagaaacaaaattaatttgttggtgaaaaacatgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacggcctctggttaaatccctcccctcctgcttggcaacttcagctagctagatatatccatggtccagaaagcaaacataataaatttttatcttgaagtaattgaatgtttttccttaaagattcttttcctactcctttctctgttacttgtgtgtttcttttccttctagttctttaaggccaaaaactgatttgcctataagtttggggcagagagcagatgataaccaatattttatagacatttttgaggtgagagtaggtggagttttcagcctctagaggagaagcaagtgacatatttgttagtctgtctttagctcttccagaaa

SEQ ID NO: 61085 - DNA, 2098 bp, Homo sapiens
ttaggaagaagtgaatagaagaaaagagggtgttgcaaatcaaaagcacatagagatatcatcttacaccagtcagaatggctattcttaaaatgtcagacaacaacagatattggattaccacatcatcaggaccacaccttcatcaggaatgaatattcctactacaattaaagaagaaacaaaattaatttgttggtgaaaaacgtaaaaagagaaattttctttggttttgtttaatttctttattgagggtcaccactaaaaaaaatgctcactggtcattcttttgaatactgtctgagagaaagatgtaagatggttgattatttcaaatgacagaagataaagatgggatatcatcatggcatgaacaaaaacaagatttgtagctggaggtattttatagtctaacatgatcaccaatcattctataaacctgttggatgagtttatcagacagacagagagagagattgattgattctgaatagaaaatttcactttagaaaaaaatattttgactatataataatgtatgtaaaaattctctttgataagaaacgagtgaactggattcaattttcctcacagcctgtgtaatacaccatcacttgcttcctcctacatgccattgattagccccagggagcagtgcagcactgcctgcccatgttttacataacccctgaatataaatgccagatgttgctgaaggaaacaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgagtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacggcctctggttaaatccctcccctcctgcttggcaacttcagctagctagatatatccatggtccagaaagcaaacataataaatttttatcttgaagtaattgaatgtttttccttaaagattcttttcctactcctttctctgttacttgtgtgtttcttttccttctagttctttaaggccaaaaactgatttgcctataagtttggggcagagagcagatgataaccaatattttatagacatttttgaggtgagagtaggtggagttttcagcctctagaggagaagcaagtgacatatttgttagtctgtctttagctcttccagaaa

SEQ ID NO: 61086 - DNA, 364 bp, Homo sapiens
ggatcaaccaacaagtgcttcctcccaaaaccccattaaaattataaggagaaaatggtacaaattcccttattcaaaaggaataaaggatggtggctgaaaaaaaagtgtaaggaacagttgaacatgcactgtacagtcacgagaacaaaggactggacacaccttcatatgaaatggaagtttatcccctgcagaattttaatcagagctcaggggcattcagcaaatgagatgacaggaatgagctgctatacggaaatcagagattaaacccacatatatggtaagacctgcagcaccattctgcagctgaagacaaaagatgctggctggccgggggggggggggggggggggaattc

SEQ ID NO: 61087 - DNA, 316 bp, Homo sapiens
atgggcatgtgggtactacgtttaaatatttaattattttaaaaataaaataggaaagataaaatagcttaaagtgtattgatgctctgaataactttatgagtgaatagatactgaaatttgaagtcagtgttttgcacaacaaatcaagatttgggactggacttactgggttggggacttcttagggataacggtggtgctatgagcatgctggaaagatgagaagcaaaagcctggaattgggagtcctgtactgtctttagggtatgcaaagaggctccttctttctaggtgttcatcagtacaatatgac

SEQ ID NO: 61088 - DNA, 857 bp, Homo sapiens
tgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgca

SEQ ID NO: 61089 - DNA, 898 bp, Homo sapiens
tgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaatggttttataagtttatttaaagtttccatattttt

SEQ ID NO: 61090 - DNA, 501 bp, Homo sapiens
  misc_feature (439)..(439): n is a, c, g, or t
  misc_feature (468)..(468): n is a, c, g, or t
  misc_feature (478)..(478): n is a, c, g, or t
ttttgatggttgcattttgtctacactatcaaacacatcaccgttatatattgtcctggcacccctaccccatcattttgtcctagttctaaatatactcagtatttaccattatccctttgccaaaactggaacctgcctaatcatttcttagtattctgaagtttgttctccagtagatgccttcattaaaggctcatggcaacaatagttcctgaatcttttttgtttactttaacatctgggaatacagacgtgagccacctcgcctggcagagcgatcattttaaaactgaaatctggagggaacctcttccctgctgctgcctttgaatgaagtctaagctcagtagcacagaacccaagtctcgtggtcagggcctactctctcagatccttcccatgtgcaccattcaccaagctttggtttgtccttganccagctttgacaaatctccacaatgcttntttctttccntttactggttttttttgaaacag

SEQ ID NO: 61091 - DNA, 164 bp, Homo sapiens
attctgtacctgttctgaacctcggccataagggacttgcagcttcgatttgctaacctgaaattctgctgctgccatggaacaagcctgggctagcttgggggaggaggagagaccatgtggagtagagccaagctctggacatttgagagagcccggtaata

SEQ ID NO: 61092 - DNA, 1345 bp, Homo sapiens
tggtggtagtggaccttgtaaataggctatgtaagggggcaagtcttctctagctcaaatggcttcctaaataaataagcggtatcttcagaaggggccattcagtccttcccagccctgctcacctgcagattctctgtacaaataactccaggtagagcagttggactccaggtcaccttagtataagttagacaaagggtccgtgagggagtagccatcaattcctgaaattccaactttgtgactagcagatggggaggatgaaaaccatccctttgcttcctctccaatacggacccatcttactgtgtcctttcctctctggggccaatgtgagtaaacacagacacagagttctttcccccagctcttcctccctcacctgcatgctgagatagcttccatccatgcagttcccaaggatctggattagaagttcaaaggggaaccagcagtcacctactcccttaggtgaagcatctcacggctgagttctccctgaggcatactggtccagctgagcgtcctagagaaagctagcaaaagggaggcacatggatttcacagtatgaattggttcaacaactgtcttagggagaatcagaaagaagagatgcagcaggggaatgagcagaacaaagatttttctttctcccccttctctctggggtctacctaaccctgacctaaaataccagggcagcgatctcccagctggtgcaggtgggcttgccaagatggtcgtccaggagcccgccttcacttctaaatctgctggccacaagccctgctaaagatacacatctcaccccctccgccaagtctgaaatgcccctccccatctcaccttagactgaaaagttttaaatcatgtcaactggataatacttgctttatgtgagaatacttcagcagaatggatacgaattttcaaaacaatcttttcatatctatgtattctatattaaaagtgataaagtcatgtttctggggcgtattcaagtagctgacaagtaattatttaataatagtacatgagtgcattgtaatgattctcgccgtagtcaggtaatagtatccaaccgaaatttcctaccaacctgctgtatccaaagttttgtaaaaagttgtagaagttgttgatctttttgattttatattcaaaaagtctctttttataaatattatttattatacaatgtatatacctttgagttaactaagattatatattatataaatatatatatatttggagaaaatatatttcatcatgcagtttttttctgttaagtcattaaagagaaggtaaacaaacctaaaatggaaacattgtacactg

SEQ ID NO: 61093 - DNA, 486 bp, Homo sapiens
ctactactactaattaaccgccgctcgacagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggtctccaactcctgaggtcgacgcggccgcgaat

SEQ ID NO: 61094 - DNA, 7271 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacgatcggccggactctcacaccatcc

SEQ ID NO: 61095 - DNA, 7719 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61096 - DNA, 7031 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctgcacgaattcccttagcaccagcacgaattcccttagcaccacacgaattccctt

SEQ ID NO: 61097 - DNA, 6810 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgatcttagacagcgcctaggtaaagaaataatgggataagatttctaaacccccctatgtgcttaagagtcatcctccccatggcgctgtctctgtcatcctctccacgtgctgacag

SEQ ID NO: 61098 - DNA, 4533 bp, Homo sapiens
tacttatccagaaaaggctcggcagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61099 - DNA, 3948 bp, Homo sapiens
tggagagacagggtcttgttatgttgccagggttggtctccaactcctgagctcaagtgatccttcagcttcagcctcccaaagtgctaggatcacaggcagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61100 - DNA, 3057 bp, Homo sapiens
tgagatagggttttgctctgtcacccaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61101 - DNA, 1639 bp, Homo sapiens
taggctagtagaggctgcgcgggttatcggccgaggcggccgagggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61102 - DNA, 4307 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagttacacaccggatttggaggcttttgagggtcctt

SEQ ID NO: 61103 - DNA, 1365 bp, Homo sapiens
tacgaaaatgttgagcatagggtggttgataccttgtttgcactcttgacataatgctatttaaaggcttgaatttttccctttatataattttcacctttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagattttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61104 - DNA, 837 bp, Homo sapiens
gcctagcgggacgactctcttaatctaccaccgctacacttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61105 - DNA, 7313 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacatcggaatgcgtgccagatttttttttttttgtcaaccaaggatatgtaggtgaacgacacacaatc

SEQ ID NO: 61106 - DNA, 7148 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccaccctgggcgggctggctagctgccttcttaggacatctctactttgaaggattttaccgcaggaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61107 - DNA, 2147 bp, Homo sapiens
acctaggtacgaggctgggtgttaatcggccgaggctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61108 - DNA, 4334 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggtctccaactcctgaggtcgacgcggccgcgaat

SEQ ID NO: 61109 - DNA, 1397 bp, Homo sapiens
  misc_feature (74)..(74): n is a, c, g, or t
  misc_feature (99)..(99): n is a, c, g, or t
  misc_feature (113)..(113): n is a, c, g, or t
  misc_feature (177)..(177): n is a, c, g, or t
aaaaataaggtgtctttattgtcttggatgccaatatagtttaaaaaatgcattgtagtgttgaatacagctgngtggaaacgtgcttccttgacagcnagagcaaatcaganggggtgtacatcagggtgacagtgggcacggagaggggccatctggccaaaccacgactcttcntctggtttgttcttcacgaccacagaggtggaaccatctctgtcaagaggagccctgccaccatcaccacaagcgtcacaccccagaaaaagaccgccactttacacaacacaatctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61110 - DNA, 7846 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagattttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61111 - DNA, 7774 bp, Homo sapiens
tgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctagctgcttagctggcatgtggccgcatgagatgccaggagacccttccctgcccatggagagtaggctgcgccccccagcccttcctgacgctcagcctcggggcctctctccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtgagagtttggcccagcctcagtccttgctcttctctggctacctctgcagggagctgcaggggcaagcactctctccagcactcaggaagcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaagaaaaaaaaaatttagccgtgtgtagcagtgagtcgcctgtaatcccagctactcgggaggctgagtcaggagaatcacttgagcctagaagttgcagtgagctatgatcatgccacactgtactccagcctggatgacagagtgaaaccctgcctctaaataaaagaaaatagaggcagactgtggtggctcacgcctgtaatcccagcactttggtaggccaaggcgggtggatcacctgcagtcaggagttcacaaccagcctgaccaacatggtgaaaccctgtctatactaaaaatacaaaacattagccacgtgtggtggtacacgcctgtaatcccagctactcgggaggctgagtcaggagaatcacttgaacctgggaggcggaggttgcagtgagctgagattgtaccactgcactccagcctgggtgacagagcaaaaccctatctcaaaaaaaaaaagaagaaaaaaatagaaaatccaaaaagaaaaaccagaaggcctgctggcgtataaatccctgggcgggtttctgataaattgccctgtgctgtcagcccctgcactgcactgctgccttccatggtgggtgggagaccccagagcggggcaggcgccactgagggcttttcttggagtcggccagcaggccacgcagcatccggcaccctgggcgggctggctagctgccttcttaggacatctctactttgaaggattttaccgcaggaagcaatagcagcgctggccattggtgctgatgacagcattgggtctggttgaggggaaggggctggaaagcagcagacccccccagtgctgcgcatggtcccggagctgtcagccaggggagtggggtcagccgtcagccagccctcccgtttcccgcccatgggccctgaccacactcccttttctagaagtcaatcctaaggtttctctgctctggctaagaggatgtaaatttggattcttagagggcatggcacccccagtccctgcccagataaagtagcacagtggcatgcagcacctctgtctgttgctgacgttggggggcttacacacccacctcatctccgtgcacagccatgactggccctgccggcagctggggtgcaggtaagggtctctctcatagaggggagctgcagctgagaactggcgaggccccttcctccaaggccctagctggcccccgggtgaacctgaggtggcaggttcaggttttcaagatggtgaggtctcgctgtctgctggacagtacgttaggctctcagaactcatgggtgtggagctgggcctgtcccgggccagtggacccctgtgtgtgggggatttggggtgctgtgggcctggttatgcactggcagatggaccttgctttggtccagctcttttccttaccctggctctgacgtgggaaggcttggagggcccgtctcatcacccccgttcgccctcagctgtccctttcccttgtcgcctggccgctgcctcgcccgcctgaggcctcctagcaggcagcctgggtgtgagttgagcctctctcttttccctctggtgggaaagtggcctttccctcaacacctgctccccggccccagaggaacccacctgttttggagctcagcttggcccagcgtttccttggggaagggaaaggagggctggacagcactgatccgggcaggcagcgtgtgcagcagtggccagccagagtgccaaagatgcacggggatgtggtgtgtggctccgggccctcgacatctctgctttgggggatttttaccttgtctgcacacttgtcaggggagaggggacagcaaggtgggaggttgaagagctttgaggctcagcagcatgtttgtggcattcggtggacaccatggccttgggcggctggacaggtttttgtgatgtgaaggacatgcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaactcttcacgttgaatgttgactttgtgtgtatgcgtgtgtgtgtgtgtgtgcacgcgcgcgtgtgcgtgtttacttcatggaattttgttttgtgaaattcccctccaatcgtgtcagaatttacctccatgccccagtcacactgttggttctgcgctctgaacctgggtgtagctcatttgaaggactctcttctgcgtttcctaacagttatttggtggtctcaagagttgaggttgtggagggttgggagaaactgaagttctatacatttccatagagtttacatcctgcagttaaaaggcagggagggctcagcccgggccccacagctccaggccatcccctacgggctgcccacagtgcccccttttctctagccgaatctttttcgaacagcccgggaaaggaaaacggattcacttgctgattttgttcacggcggaagcaccatgttccgttcctttttcaggttcagtttgttgtgtaaatggcggttttttctggtgtgagctttggtgatggtggcagggctcctttgaagagatggttccacctcgtggtctgaagaacaaaccagagaagagtctggtttggccagaggccccctccggtccacgtcaccctgagtacacccctctgattgctctgctgtcaagaagcacgtttccaccagctgtattcaacactacaatgcattttttaaactatatttgcatccaagacaataaagacaccttattttttttgaaaagccaaaaaaaaaaaaaaaaaaaaaaaaaacctttgcgggccccctcgggcccccaaagaagccccttcccacagccaacacaatcccgatgggggcagcgcgcggcgcccccacaataaggggatacgtcgcgacaacatggttggcacatcaaggctggtgttcccccaagagaggaaaaaccccggggcacacggatgaacaacagagcgccgggaggtaaacttaaccacccacaatataaagaaaaacggcccggggggaacaccggggagcggctcctggcacaacaaacccccagaaggtggatctctccaaagcaccaccaaacggggacctcatcacaaccagcggctcccaaggcagagaccgcgactacgacaaataagcgcccgcgacccgtggtcacacacaagagagcgacaggaaagacgcggcacgactacacccgaaagacgcacacggccgcaccgcgagcacaccacgctgcccaaacacacacacacgac

SEQ ID NO: 61112 - DNA, 1239 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggctggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61113 - DNA, 1587 bp, Homo sapiens
gttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccagaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgagaaagggtagagaaacaggcctgagaggggattcagggagcagggtgtctggggccctctgcatgggggagccctgtacccatgccgcaccctccatggcaagctgcctcccatcttctccccaggtgatgaacatgtatggagacctggtcatggacacagtccctgaaaagtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaa

SEQ ID NO: 61114 - DNA, 612 bp, Homo sapiens
cgaattggtacacttacctgtacccaccggggtggaaaatcggatgggccggccgctctagaagtactcaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctatatatatatatatatataaatataaatatataaatgccacggtcctgctctggtcaataaaggatcctttgttgatacgtaaaaaaaaaaaacactt

SEQ ID NO: 61115 - DNA, 665 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagaggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61116 - DNA, 1487 bp, Homo sapiens
gaaaccgttgggcagagtacatgaaaggaggcccgagtcagggtccagaggagaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61117 - DNA, 1736 bp, Homo sapiens
gttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61118 - DNA, 2494 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61119 - DNA, 1084 bp, Homo sapiens
tgagagaatacttgttgatttctgatgtgagtccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61120 - DNA, 874 bp, Homo sapiens
  misc_feature (6)..(6): n is a, c, g, or t
cttggngcgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61121 - DNA, 565 bp, Homo sapiens
cgaattggtacacttacctgtacccaccggggtggaaaatcggatgggccggccgctctagaagtactcaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61122 - DNA, 2421 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcacacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatagctctggtcaataaaggatcctttgttgatacgtaaaaaaaaaaaacactt

SEQ ID NO: 61123 - DNA, 1790 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggctggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61124 - DNA, 1833 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccagcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctatatatatatatatatataaatataaatatataaatgccacggtcctgctcatgataaataaaggatcc

SEQ ID NO: 61125 - DNA, 425 bp, Homo sapiens
gtcagttgtggagcaggaagtaatctgttttagaacaccaaaacactggcttcactggttctcttctggacttctccatcccacattgggactgggtctctagtcttgggcctctggccttcatagagctccctgctaacctccaactcagtgtattttctccatctaaaacattctatcaagtaagaacactagctttagagtcaggctgtttttgaaccccaggctgtgggaccctggctccctttggggatgttctctgaaggatggagacacatctcatatgaaatgtgtagcacaggtcctgacacggggggtttctcatggcttgctttgttaacacccagtactgcaagcatctggccctgtctcagccattcagcttcacccagcaggacatgcccaaacttcgtcggcagatctac

SEQ ID NO: 61126 - DNA, 2572 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61127 - DNA, 1266 bp, Homo sapiens
ctagaggaccccgagctcgggactgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61128 - DNA, 2021 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61129 - DNA, 2107 bp, Homo sapiens
gttttcatttctaaatgctaatcctttttctttcttcctgtctatgagtaggaactctctctccatccctgtagaatctcttggacatgtttatctcatgcttatggggtccccatttcttggagtgggattgacattggtggattctgcttcagtgtatccttcttgcggtcttatttgcatgcatgagtcaactgtgtgcatcccattgtgctttccccaggccagtctctcatgcccattccatttcccctgccctataggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccagaggtgaggcttgaaagccctccttgaaagaagggctggggccttggggatgtggagagaatactgctgccttttcttccatagggctgtagttggggaggaggaagctagagctgaaggggaggactctgcaggcaggtgccaaatccttggaagctgatgggagagtctttacctgggaccctgaaatgttctacctgagtagtcatgtttatctttctggggagtgggcctttcgcaggtcctcagaaggacccatcatgagccagaaaaaagggagtcagttagaatttgtattccagggagtagtaggtatttctgtgtgccccagctgcatcatcttttgtgtgactccacccttggcctactcaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61130 - DNA, 2521 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctgctctggtcaataaaggatcctttgttgatacgtaaaaaaaaaaaacactt

SEQ ID NO: 61131 - DNA, 2619 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcagggggtggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatatatatatatatatatatataaataaaaatgccacggtcctatatatatatatatatataaatataaatatataaatgccacggtcctgctctggtcaataaaggatcctttgttgatacgtaaaaaaaaaaaacactt

SEQ ID NO: 61132 - DNA, 1923 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaagtaggcccaaccagataggtcagtacccagaggaacttctgcagttttaagcagctttttaagctcctttcatctctttcattttacacagagagggtctctgtttcagggagagaggtggtagtggtagtgtattaatttcaaatccgtaatcttgggctctggatttatcagttgttttcctttctgccagtatttagtgtttttcgctatggccagccccaaggattgggatgggttcctattgtaactattgtaaaacaagatttaaaaaaaa

SEQ ID NO: 61133 - DNA, 947 bp, Homo sapiens
ggtggccgcgccggcgctcttcgccgggtgtgacgtactaatcgtgcgccaccgctgccggtgggcccggggctcgcgggaggggaaggaggagggggggaggagtggcggcggcggcggtggcgctggtggcggcggtggcggaggtggaggtggaggtggaagctgaagctgaagcagagccagaggcggcgcggcggggtgctcggcggcgcggcacgggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagatcatcctcccccttccccgtgcagggagcaggaaatcagtgctgggggtggtgggcggacaataggatcactgcctgccagatcttcaaacttttatttatatatatagctctggtcaataaaggatcctttgttgatacgtaaaaaaaaaaaacactt

SEQ ID NO: 61134 - DNA, 710 bp, Homo sapiens
gttcagatacccttttataataactgtcttcttagtatattaacactcaagatgtttgtgtatctttaatttgcctttgtttcacaataactggcttttgttttccttttcatggtgtgttgttggctatatagaggcatttattggtaaattataatcagcagttgcaccatggaagtattcttggtgataaattcttggggttacatagtatagttaacatgttattttcaagaaacatgagtgtgtgtgtctgtgtgtgtgtgtctgaagagtatcacttatatgcagtgcatatacatgtaagtgcattactttgctcaaatatcttctgacctattacagtcaactcatgcatgagtgtgaacatgtattacagaaggtcttacagccttagtttctgttttagattttatgtgctgcttcctttctcaaacaaaagcatgaaaggaaagaggataagtactagaaatattcatttttttccttcacaaatctaaatgttgcttatgaaaactcatcttagagtaatgaatatgtggaagtgggtaggtaggaggaaatgtgcctctttaaaatcctaaaattttaccattgatattgacatttgtttgcgtgtatataaatggagcatgtgtaaatatagaattccaatagcattttttattttattataaatctataataaatatatataaatcactaccaga

SEQ ID NO: 61135 - DNA, 2709 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcgggtaagtggtcttttcactcttctccagcctttcttgctacccttcaatcttcctctctcactacccttcaatctccctgtccttccaattcccgttctttttcctctctagtagagataaggagacacattttatctgtggacccaaaactccagcgtcagtcacggactcgggaagacagtcttcccttggtgtttaatcactgtggggacgcctgcctgattattcacccacactccattggtgtctgatcaccacggggatgcctgccttggtcattcacccacattcccttggtgacaagtcaattgcggggacacctgctttggctgctcacccacattgcagcccagggctgctcaatgccccccgctgccccacccgccttctccgtgcctctaccctctcttttctcgggtttacctccttcactatgggcaaccttccaccctccattcctccttcttctcccttagcctgtgttctcaaaaacttaaaacctcttcaactcacacctgacctaaaacctaagtgtcttattttcttctgcaacaccgcttggccccaatacaaactcgacaatgattccaaatagccagaaaacggcactttcgagttctccatcctacaagttctagataattcttgtcataaaatgggcaaatggtctgaggtgcctgacgtccaggcattcttttacacattggtccctccctagtctctgctcccaatgtgactcatcccaaatctttcttctttctctcctttctgttccttcggtctccaccccaagttccgagtcctctgaatccttcttttctatggactcatctgacctccccccttctccccaggctgctcctcgccaggctgagccaggtcccaattctcacttagcctctgctcccccaccctataatccttttatcacctcccctcctcacacctggtccagcttacagtttcgttcctcgactagctctccccgatctgcccaacaatttcctgttaaagagatggctgactatcctgacttcatcagagcaggctggtgcctggccttcctggaatgagtgggtgttctgacaggcccccagtttgtcccatctgcaccgccaagaggtctccgggtggccagaggagcaaagttgccttccaagtgcctgttggtgcctgggagaacacagcaggagtgtcgtgcggcccacagcgcagtgcatggtgattccaggcgctgaacaactccccttgacccttgggcctgcatctgactcccggctgcagaatcagaagctgagtccaggcaaccgctcggccactcccggtcactcctctctggacacccagttactaaagtcagcaaagaagatgcggtaatcaccgcctgatctccacatggtgaacacaacactctcactaacacctccttgaccagtcagtcttcagcactgggggtggacaggcaggttttctgtgtttaccagaatcgcacaggctaagcacaaacatggaaccagagttccaggtgaggaaacctcactcgcagaagcccaggctgcaccccaccaggtgatgcagtgcgcctaggctgtgggtgctaggagccaagtgctagggactcgtcatgagtgggaatccccacgttcctgtcactgctgtcaaacagaaggtaaacagtcttacgaatgtaattccttaggaagacttgtacaaacttttattaggatatctatttatttaatactgaactttggcctactttgtgataagactataaacaaattgaggaaatcactatttctcacttctgtatttctcaaaaaataattttgttacagagttcaatatactgtgtactactgatcttctattgtgaaagcaaagcatttcatcaaaacaaagtattttaaattatgagtgaaaattgtgtat

SEQ ID NO: 61136 - DNA, 1649 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggataggagtgtcaggcctctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgcccttgagaatgtactttgtacacctatcccaaacctataagaactaatgataatcctaccaccctttgctgactctctttttggactcagcccgcctgcacccaggtgaaataaacagccctgttgctcacacaaaagaaaaaaaaaaaaaaaaaaaaaaagaaaaaaaaaaaaaaaaaaaaaaaaaaagaaacaagaaacataagaaaaaagaggcgcggcgcgcctataataaaaatctacccgagagggacaccacactattagcgagccacccgcagtttttttagtcacaaatgagggcaccacataagggagggatatattacacgaacgcaggcatggcgagcgccgaatatcaaaacaacacgccgcgacccggcagccgggacaacacacgccgacaccaacgtggaggaacactcttggcacgacagcgaacaaccaccccccacaccattatcggggggggggggcgcttaagcattattttggtgggcgacgagaccagaaatctacactaagcgaataaatacaactgacaaacctcgcggaggaggaagacatttatactgaaaatctaccagagggtcactcataactggtggtggtgacacacgcgcacccacgccgatttagtcacgtgcgcgacgtaatacagtaatctgtgtctcctcaggacgatgatttaactagtaaacacaaaagattttctacgcgg

SEQ ID NO: 61137 - DNA, 1590 bp, Homo sapiens
ggtggcatgcgcgtgaagtcttagctacttgggaggctacggtgggaggatggcttgagcttaggagtttgaggttacaggaagctatgattgtgccactgccctccagcctgggtgatggagtaagaccatgtttcaaaaacaaaacaaaaaaaaaagaaatgcaagttagaccaatgaagtataatgtaatgaaatacaaaaaattcattgctatggtttcaaattcccagtgcaattaacctttaagatactacgtgtcaggcctctgagcccaaactaagccatcatatcccctgtgacctgcatgtatacatacagatggcctgaagcaactgaagatccacaaaagaagtgaaaatagccttaactgatgacattccaccattgagatttgttcctgccccaccctaactgatacgatatattctcccccgcccttaagaagactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggataggagtgtcaggcctctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgcccttgagaatgtactttgtacacctatcccaaacctataagaactaatgataatcctaccaccctttgctgactctctttttggactcagcccgcctgcacccaggtgaaataaacagccctgttgctcacacaaaagaaaaaaaaaaaaaaaaaaaaaaagaaaaaaaaaaaaaaaaaaaaaaaaaaagaaacaagaaacataagaaaaaagaggcgcggcgcgcctataataaaaatctacccgagagggacaccacactattagcgagccacccgcagtttttttagtcacaaatgagggcaccacataagggagggatatattacacgaacgcaggcatggcgagcgccgaatatcaaaacaacacgccgcgacccggcagccgggacaacacacgccgacaccaacgtggaggaacactcttggcacgacagcgaacaaccaccccccacaccattatcggggggggggggcgcttaagcattattttggtgggcgacgagaccagaaatctacactaagcgaataaatacaactgacaaacctcgcggaggaggaagacatttatactgaaaatctaccagagggtcactcataactggtggtggtgacacacgcgcacccacgccgatttagtcacgtgcgcgacgtaatacagtaatctgtgtctcctcaggacgatgatttaactagtaaacacaaaagattttctacgcgg

SEQ ID NO: 61138 - DNA, 1857 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacatggcctgaagcaactgaagatccacaaaagaagtgaaaatagccttaactgatgacattccaccattgagatttgttcctgccccaccctaactgatacgatatattctcccccgcccttaagaagactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggctctccccgatctgcccaacaatttcctgttaaagagatggctgactatcctgacttcatcagagcaggctggtgcctggccttcctggaatgagtgggtgttctgacaggcccccagtttgtcccatctgcaccgccaagaggtctccgggtggccagaggagcaaagttgccttccaagtgcctgttggtgcctgggagaacacagcaggagtgtcgtgcggcccacagcgcagtgcatggtgattccaggcgctgaacaactccccttgacccttgggcctgcatctgactcccggctgcagaatcagaagctgagtccaggcaaccgctcggccactcccggtcactcctctctggacacccagttactaaagtcagcaaagaagatgcggtaatcaccgcctgatctccacatggtgaacacaacactctcactaacacctccttgaccagtcagtcttcagcactgggggtggacaggcaggttttctgtgtttaccagaatcgcacaggctaagcacaaacatggaaccagagttccaggtgaggaaacctcactcgcagaagcccaggctgcaccccaccaggtgatgcagtgcgcctaggctgtgggtgctaggagccaagtgctagggactcgtcatgagtgggaatccccacgttcctgtcactgctgtcaaacagaaggtaaacagtcttacgaatgtaattccttaggaagacttgtacaaacttttattaggatatctatttatttaatactgaactttggcctactttgtgataagactataaacaaattgaggaaatcactatttctcacttctgtatttctcaaaaaataattttgttacagagttcaatatactgtgtactactgatcttctattgtgaaagcaaagcatttcatcaaaacaaagtattttaaattatgagtgaaaattgtgtat

SEQ ID NO: 61139 - DNA, 1308 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacatggcctgaagcaactgaagatccacaaaagaagtgaaaatagccttaactgatgacattccaccattgagatttgttcctgccccaccctaactgatacgatatattctcccccgcccttaagaagactcagcccgcctgcacccaggtgaaataaacagccctgttgctcacacaaaagaaaaaaaaaaaaaaaaaaaaaaagaaaaaaaaaaaaaaaaaaaaaaaaaaagaaacaagaaacataagaaaaaagaggcgcggcgcgcctataataaaaatctacccgagagggacaccacactattagcgagccacccgcagtttttttagtcacaaatgagggcaccacataagggagggatatattacacgaacgcaggcatggcgagcgccgaatatcaaaacaacacgccgcgacccggcagccgggacaacacacgccgacaccaacgtggaggaacactcttggcacgacagcgaacaaccaccccccacaccattatcggggggggggggcgcttaagcattattttggtgggcgacgagaccagaaatctacactaagcgaataaatacaactgacaaacctcgcggaggaggaagacatttatactgaaaatctaccagagggtcactcataactggtggtggtgacacacgcgcacccacgccgatttagtcacgtgcgcgacgtaatacagtaatctgtgtctcctcaggacgatgatttaactagtaaacacaaaagattttctacgcgg

SEQ ID NO: 61140 - DNA, 804 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacatggcacacaaggagattatatcccgcacctggcttggaggatcctacgcccatggagcctcgctcattggtggcacagcagtctgagatcaaactgcaaggtggcagcgaggctgggggcagggcgcccaccattgccgaggcttgagtaggtaaacaaagcacccgggaagctcgaactgggtggagcccaccccagctcaaggaggcctgcctgcctctgtagactccacctctgggggcagggcatagccaaacaa

SEQ ID NO: 61141 - DNA, 1686 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggataggagtgtcaggcctctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgcccttgagaatgtactttgtacacctatcccaaacctataagaactaatgataatcctaccaccctttgctgactctctttttggactcagcccgcctgcacccaggtgaaataaacagccctgttgctcacacaaaagaaaaaaaaaaaaaaaaaaaaaaagaaaaaaaaaaaaaaaaaaaaaaaaaaagaaacaagaaacataagaaaaaagaggcgcggcgcgcctataataaaaatctacccgagagggacaccacactattagcgagccacccgcagtttttttagtcacaaatgagggcaccacataagggagggatatattacacgaacgcaggcatggcgagcgccgaatatcaaaacaacacgccgcgacccggcagccgggacaacacacgccgacaccaacgtggaggaacactcttggcacgacagcgaacaaccaccccccacaccattatcggggggggggggcgcttaagcattattttggtgggcgacgagaccagaaatctacactaagcgaataaatacaactgacaaacctcgcggaggaggaagacatttatactgaaaatctaccagagggtcactcataactggtggtggtgacacacgcgcacccacgccgatttagtcacgtgcgcgacgtaatacagtaatctgtgtctcctcaggacgatgatttaactagtaaacacaaaagattttctacgcgg

SEQ ID NO: 61142 - DNA, 1813 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacatggcctgaagcaactgaagatccacaaaagaagtgaaaatagccttaactgatgacattccaccattgagatttgttcctgccccaccctaactgatacgatatattctcccccgcccttaagaagactcagcccgcctgcacccaggtgaaatatacagccttgttgctcacacaaagcctgtttggtggtttcttcacacggatgcatgtgacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggataggagtgtcaggcctctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgcccttgagaatgtactttgtacacctatcccaaacctataagaactaatgataatcctaccaccctttgctgactctctttttggactcagcccgcctgcacccaggtgaaataaacagccctgttgctcacacaaaagaaaaaaaaaaaaaaaaaaaaaaagaaaaaaaaaaaaaaaaaaaaaaaaaaagaaacaagaaacataagaaaaaagaggcgcggcgcgcctataataaaaatctacccgagagggacaccacactattagcgagccacccgcagtttttttagtcacaaatgagggcaccacataagggagggatatattacacgaacgcaggcatggcgagcgccgaatatcaaaacaacacgccgcgacccggcagccgggacaacacacgccgacaccaacgtggaggaacactcttggcacgacagcgaacaaccaccccccacaccattatcggggggggggggcgcttaagcattattttggtgggcgacgagaccagaaatctacactaagcgaataaatacaactgacaaacctcgcggaggaggaagacatttatactgaaaatctaccagagggtcactcataactggtggtggtgacacacgcgcacccacgccgatttagtcacgtgcgcgacgtaatacagtaatctgtgtctcctcaggacgatgatttaactagtaaacacaaaagattttctacgcgg

SEQ ID NO: 61143 - DNA, 1015 bp, Homo sapiens
  misc_feature (17)..(17): n is a, c, g, or t
  misc_feature (20)..(21): n is a, c, g, or t
  misc_feature (112)..(112): n is a, c, g, or t
gctttttgtgagacccnttnncactgtgcaatttttgcattatttaccctcccccgacaacctgtatccttggccctttctgattttctctgcttggtctctttcggtcgancggggattaccggggagtcggcctcggggctctgctctcctacctcagtctgccctaccctggaatggggaaaatgcggacatgccactcagtccggccgcgaacagtgctccagaactcagagagttttccagacgggtggagatcgcgttccctgcccgccgaggtcccatcgcttccctgctgggaagacaaatgaggcgctttagccgtctccacggccagcccctccctcataacccgagattctttgtgggctcttagtccatagctgcctttgaggtggtgtagaccttgctaaccaggacggcccagtaggcagagctcatttttattcctgtctgcaatcgtgcaaaaacgcctcttatggaaaagccagagcgccaggagtcagcaaaacacactaaagattgggcagtcactggggagaacgtgagtaaaagcacaggaacagcaaagcgttcaggaacgttcgaggctgacgcaaccggcgcaggaaggtggtgtgtggtgggagagtgggaggagacagtggaaagtttagacttgcttctgtaagtgataagaagtcatcagatattttcaagcaggagaggaaaataatctctctgtttcgcaaagttaactctcatggcaacagagcagagtagcggggggatgggggctgggagatgttgggaagctattgttaccactctggtgaagagtcatgggacctcaaaagctgggatagtcacggtgggaatggaaaggaagggcacaagctgagaggcatttgggaggagaatcaatagcactttattgactggatgtgtgagatgagtgaggacagcaatcagaagaggactttgaggtttctagcctgagtggctggaaggacaccacttcccctacctgaaatag

SEQ ID NO: 61144 - DNA, 329 bp, Homo sapiens
ggtttcttcatcatcacgtgaacacagagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccaga

SEQ ID NO: 61145 - DNA, 489 bp, Homo sapiens
ggtttcttcatcatcacgtgaacacagagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagattgcccagagcaagactctaatgttcccaacggtgatgacatctagggcagaatgctgccattttgaggggcagggggtcagctgatttctcatcaagataataatgtatggtttttacactaagcaactgataaatggacaatttatcactggaaaaaa

SEQ ID NO: 61146 - DNA, 285 bp, Homo sapiens
gagatggaatctctctctgtcacccaggctggagtgcagtggcgcgttcttggctcagtgcaacctctgccttctgggttcaagtgattctcctgcctcagcctcctgaacaggcatgagccactgcgtctggccttctataattttctggtagtcacgatggaaacaaacaaaacaccttagaaccagagatcgaccccctcaagcaatacatcaattcccttttaagccacataggacacaccaatgctccacaatcgtttgctagactagttgcatcatgtc

SEQ ID NO: 61147 - DNA, 5044 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccaga

SEQ ID NO: 61148 - DNA, 5204 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagattgcccagagcaagactctaatgttcccaacggtgatgacatctagggcagaatgctgccattttgaggggcagggggtcagctgatttctcatcaagataataatgtatggtttttacactaagcaactgataaatggacaatttatcactggaaaaaa

SEQ ID NO: 61149 - DNA, 5057 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaactttattttccatgtacagtttcagattatacaaaacacagaaaatggactattttaaaggtacattaaggtcgacg

SEQ ID NO: 61150 - DNA, 4896 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggactactccccaggatcctgctagagtc

SEQ ID NO: 61151 - DNA, 5298 bp, Homo sapiens
  misc_feature (5113)..(5113): n is a, c, g, or t
  misc_feature (5130)..(5130): n is a, c, g, or t
  misc_feature (5134)..(5134): n is a, c, g, or t
  misc_feature (5141)..(5141): n is a, c, g, or t
  misc_feature (5144)..(5144): n is a, c, g, or t
  misc_feature (5149)..(5149): n is a, c, g, or t
  misc_feature (5171)..(5171): n is a, c, g, or t
  misc_feature (5189)..(5189): n is a, c, g, or t
  misc_feature (5216)..(5216): n is a, c, g, or t
  misc_feature (5220)..(5220): n is a, c, g, or t
  misc_feature (5230)..(5230): n is a, c, g, or t
ccggagcaggcctgggagtccttgcagggtggcctgggtgactgctcaccagcccggccctccccagggttctgggccagagcctccctggccgttggagcgggagctgtgggtggaacacttctgaattgggagattgcctcggacctccagacgccgaacatctcagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61152 - DNA, 4989 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtattacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccaga

SEQ ID NO: 61153 - DNA, 4709 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacgggacacgaatgtacaggtgagccgagctcgattc

SEQ ID NO: 61154 - DNA, 4264 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagattccatctcaaaaaaagaaaaaaaggaaaagaattatttacttgtgatggaggttgcaaagaacaccagggcccgccaaagggttttaccccatgaacaatgtgtgggatcctgacttttggttacacgagtgattggtcccaatattggaatctgatttaacattctgtggtaacccaggtatttgattgaagaaggggtcactaaggggagacatgacttgttcctattttcttttcatggaaaacctgtttttccccctattaagcatatttactcggggtcattttccttcttgtggaggttctaattaaaaattctgggacattcactttaaaatagttactttgcctctgtagtggtggcattcataaacatgggaggttttactctctttcaaatgagtttttttgaacaattttttggtgttactggaaccaccgcagtaagtttaagaccgggattggaactcatttcttccagaatggtaagtcaagctagggacaatacatatctagcgcaggttaattcaaaactcggcgaaaagatagagtggaacaacagagatata

SEQ ID NO: 61155 - DNA, 2244 bp, Homo sapiens
  misc_feature (2059)..(2059): n is a, c, g, or t
  misc_feature (2076)..(2076): n is a, c, g, or t
  misc_feature (2080)..(2080): n is a, c, g, or t
  misc_feature (2087)..(2087): n is a, c, g, or t
  misc_feature (2090)..(2090): n is a, c, g, or t
  misc_feature (2095)..(2095): n is a, c, g, or t
  misc_feature (2117)..(2117): n is a, c, g, or t
  misc_feature (2135)..(2135): n is a, c, g, or t
  misc_feature (2162)..(2162): n is a, c, g, or t
  misc_feature (2166)..(2166): n is a, c, g, or t
  misc_feature (2176)..(2176): n is a, c, g, or t
ctgtcctgggagtgggggtgtgtctagccgtcgctgcctcttgaagagtactattgtcgctgcttgtacctttctgtcatgagtgcgcacgtgcgtggtgttgtccactcacgactcagtttccagctcgacctggtccaccacctctggtccgattactatcaacgcgtgccaccgatcggcatgactctcattccacactagcacgagaattcgagcgtctatcccgatcatgcgtcagttgcagtctcattgtagtctgctggagcagatagtatttacataggtcctaccaatgtgccaaggccatcctcgtagtagaaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61156 - DNA, 2309 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggccggtattgagtggccggtattgagtggccatgtgatcatcaatggggatcctct

SEQ ID NO: 61157 - DNA, 1208 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaggaaagaaaaaaaaaaaaaaggggggggggcgaaaagaaatcacccccaggggggccaagtttaggcgcgcacacccagtcttctgggacacaaaggggcgccccaaacaggggaagacggtcttaataagcagagaacggggcccgccataaacacggctctctggcgcgccaacacggacagcggggcacttggggaagggacccccaactgcgggggggacacagggggacccatcccaacagatatacggccagggaacataacatcagggtctagggctcgacacacggatgtccggcgagaaactgccacgggagttcgagcactcc

SEQ ID NO: 61158 - DNA, 936 bp, Homo sapiens
  misc_feature (751)..(751): n is a, c, g, or t
  misc_feature (768)..(768): n is a, c, g, or t
  misc_feature (772)..(772): n is a, c, g, or t
  misc_feature (779)..(779): n is a, c, g, or t
  misc_feature (782)..(782): n is a, c, g, or t
  misc_feature (787)..(787): n is a, c, g, or t
  misc_feature (809)..(809): n is a, c, g, or t
  misc_feature (827)..(827): n is a, c, g, or t
  misc_feature (854)..(854): n is a, c, g, or t
  misc_feature (858)..(858): n is a, c, g, or t
  misc_feature (868)..(868): n is a, c, g, or t
gggcgctccaggattaccgggagtatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61159 - DNA, 1115 bp, Homo sapiens
  misc_feature (930)..(930): n is a, c, g, or t
  misc_feature (947)..(947): n is a, c, g, or t
  misc_feature (951)..(951): n is a, c, g, or t
  misc_feature (958)..(958): n is a, c, g, or t
  misc_feature (961)..(961): n is a, c, g, or t
  misc_feature (966)..(966): n is a, c, g, or t
  misc_feature (988)..(988): n is a, c, g, or t
  misc_feature (1006)..(1006): n is a, c, g, or t
  misc_feature (1033)..(1033): n is a, c, g, or t
  misc_feature (1037)..(1037): n is a, c, g, or t
  misc_feature (1047)..(1047): n is a, c, g, or t
agcctaccatgtactcccagactctaaagctaaattgggagacagaatgcctagggaatagatcattgtgaagttctgagctcttttgagggactctatagccttctttctttaggggatccacttgcctgctgtgggaaatcatagtgagtgatttacagggatccttctcctccaagctgcattggcttcttatatcctttgcgaccttgggctgaaagagaaacagctgcaaatgttgtgctgtctctttgaggttgtcttggggacagttccccgcaaaggtcattcctagcttttgaggtcaatgttaggtctacctggccaggtagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61160 - DNA, 325 bp, Homo sapiens
taagtagctgggactgcaggtatgacgaccacgcccagctaattttcttttattgtttttatagacagtgtcttactatgttgcctgggctggtctcaatctcctgggctcaagtgatcttcccaccttctcccaaagttccaggattataggcatgagccaccacgcccagctaaaaggtgtttattttttattgtaattttgttttgtcattgacagattttgaatttctctttcttaccctcttcagcacatcccgctctgggctttaaacgtgacccctcgcctcgactcgccctgccctgtgaaaatgttggtgcttctt

SEQ ID NO: 61161 - DNA, 5279 bp, Homo sapiens
  misc_feature (5094)..(5094): n is a, c, g, or t
  misc_feature (5111)..(5111): n is a, c, g, or t
  misc_feature (5115)..(5115): n is a, c, g, or t
  misc_feature (5122)..(5122): n is a, c, g, or t
  misc_feature (5125)..(5125): n is a, c, g, or t
  misc_feature (5130)..(5130): n is a, c, g, or t
  misc_feature (5152)..(5152): n is a, c, g, or t
  misc_feature (5170)..(5170): n is a, c, g, or t
  misc_feature (5197)..(5197): n is a, c, g, or t
  misc_feature (5201)..(5201): n is a, c, g, or t
  misc_feature (5211)..(5211): n is a, c, g, or t
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61162 - DNA, 3818 bp, Homo sapiens
  misc_feature (3633)..(3633): n is a, c, g, or t
  misc_feature (3650)..(3650): n is a, c, g, or t
  misc_feature (3654)..(3654): n is a, c, g, or t
  misc_feature (3661)..(3661): n is a, c, g, or t
  misc_feature (3664)..(3664): n is a, c, g, or t
  misc_feature (3669)..(3669): n is a, c, g, or t
  misc_feature (3691)..(3691): n is a, c, g, or t
  misc_feature (3709)..(3709): n is a, c, g, or t
  misc_feature (3736)..(3736): n is a, c, g, or t
  misc_feature (3740)..(3740): n is a, c, g, or t
  misc_feature (3750)..(3750): n is a, c, g, or t
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61163 - DNA, 3689 bp, Homo sapiens
  misc_feature (3504)..(3504): n is a, c, g, or t
  misc_feature (3521)..(3521): n is a, c, g, or t
  misc_feature (3525)..(3525): n is a, c, g, or t
  misc_feature (3532)..(3532): n is a, c, g, or t
  misc_feature (3535)..(3535): n is a, c, g, or t
  misc_feature (3540)..(3540): n is a, c, g, or t
  misc_feature (3562)..(3562): n is a, c, g, or t
  misc_feature (3580)..(3580): n is a, c, g, or t
  misc_feature (3607)..(3607): n is a, c, g, or t
  misc_feature (3611)..(3611): n is a, c, g, or t
  misc_feature (3621)..(3621): n is a, c, g, or t
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctggacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61164 - DNA, 4556 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttgg

SEQ ID NO: 61165 - DNA, 3145 bp, Homo sapiens
  misc_feature (2960)..(2960): n is a, c, g, or t
  misc_feature (2977)..(2977): n is a, c, g, or t
  misc_feature (2981)..(2981): n is a, c, g, or t
  misc_feature (2988)..(2988): n is a, c, g, or t
  misc_feature (2991)..(2991): n is a, c, g, or t
  misc_feature (2996)..(2996): n is a, c, g, or t
  misc_feature (3018)..(3018): n is a, c, g, or t
  misc_feature (3036)..(3036): n is a, c, g, or t
  misc_feature (3063)..(3063): n is a, c, g, or t
  misc_feature (3067)..(3067): n is a, c, g, or t
  misc_feature (3077)..(3077): n is a, c, g, or t
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtaaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagaaaaaaaaattgcttcaacagtgtttggacggaacagatccggggactctnttccagccttcgaccgncctncgatttnctntccgnttgcacctccgggaccatcttntcggccatctcctgcttntgggacctgcaacaccggttttgtggntagntccttcttgncaacaaccatgagctcccagatttgtagaattattcacccgacgtggaagcagccgcaccctggtctt

SEQ ID NO: 61166 - DNA, 4706 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttgagactgagttttgctcttgttgcccaggctggagtgcggtggcaccatcttggctcaccgcaacctctgcctcctgggttcaagtgattctcctgcctcagcctcccgagtagctgggattgcaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactactgtacaacattcagtgcccacatccatctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggttcttcggcgtgtgcatgcacacgcggaaaaaccaacactacctgatgccccttccccaatttggggactttttgataatatgaatatatctgtatattttaccctatggtgctgaggcctgtgatcggtatggtgactcggtgtgtgca

SEQ ID NO: 61167 - DNA, 3494 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaacaaaacaaaaaaaagaaaaaagaaaaaaaaattccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccaaaagagcaaagaccccaaaagagcaaagaccccaaaagagcaaagaccccaaaag

SEQ ID NO: 61168 - DNA, 680 bp, Homo sapiens
tccagatcgtctattttgtgagtaacttggaaatgttaaggtattctgtaacagcttgaagaaacaatagacagctcacttaagcatgaatgtacctagatatattatatttaccctccatacacataaccaggatgactggctttggcagctggtaccaagaatagtaggaagccaactatttatgataagaattggtccatactgggaccctccctttcacccccttgtacttatgctcacctcctggctctcccttgttattgctcacttgcaatgtgtcttagtcattaagaaaattacatgtgtttttatgagaagctgtatattacagtaattaagggcatgtgctcggaggttagagagtgcttggattggaatcctaaatctgaataaccttgggcaaattacttaagatggggataaagatagtgtctatctcatcctgctgttattcttatttactgaaacaactggaaaagagcacctcagacaacactcagcacacagtatccaataagtgttcactacacctgcatctgcctgcctgtttctactgtgtcctccctgcaggataaaaaacctgtttccttctttcaggacttcagaactccatacctactgcttagatttaccaaatcagaaccacatcttttacttttggtttcttggtatttaaa

SEQ ID NO: 61169 - DNA, 269 bp, Homo sapiens
agtttcatacataatgccaaacttttttttcacagtggttataccaatttgcactctcaccagcagttgtcctatagccttgacaacacttggaattgttaggtttttaaattttgccatggtgagtgtgaaaagtggtggttatttttttgtttggttattattatttatttaatgagagattgggtcttgccacactgcccaggctggtcttgaactcttgggctcaagtgatcctcccaccttggtctcctaaagtgctgggatta

SEQ ID NO: 61170 - DNA, 300 bp, Homo sapiens
agggtcagtctccgagaaaaaacaaaaacaaaaacaaaaacaggcagcccgcagaaaacccagaaacaaccgaaccggggcagttttacattgctttgggttttttgagggggcggggtgagggggtacgagacaagtccccaagttttctttgcttttttttttcctttgctttttcttcttttatttttttatttgtttgcattttttttcccctcctggtagaagtgcgctttccacctaccagaccctgaaagaaagtgtcaggagccggtgcaaaacccagtttaagttcaagaa

SEQ ID NO: 61171 - DNA, 654 bp, Homo sapiens
ttatgtggggtggtggtagttaaacagtaagtacagttacgtgaatctagcttttctggtgtccccaagcgttcaaacagcttttttggtaaaatgaatcctgggaaactaaaagtacccctaccttttgcgtttcctgctgcctcagtccctccagtttgagttagttttcctctagaggctttggagggaaagttttcctcttgccacactcaccttgaagcaggacgtaatggattgccgtggctttcactatgcatcttgtctcaatacaggccttcgggggacaggcctgcgacattacccagtctacaaaggcagattgaatatgaaagcctcaaccatcacatcaagccacagatcaatcatagccaccacacagagaaaattaccatttggcaacatccatcatctttacaagtgctacccacatctaactccacctgagccatcattgttgccgcttacttctatcttcagtgaggctggaagtcaacaaaagggtcttattccctttattgggagaggagaggagagtagcacagaaacgcctttctgaggggtaactgtctttccaatcctggattcccttgttgtcaactccctcttcacgcctcattttatgaaatcaataaagaactgaagctcttcttg

SEQ ID NO: 61172 - DNA, 783 bp, Homo sapiens
cgccagcacctaggctggtcttccctgggtgcctgcttgagcacgtggcccaaaacagccgttgcatggggcactcagaacccaccacaccctcgccccttcccagcccgccaccctgtggctgaggccctgtgccttgagcaagctgctgcccctcctcctcctggtccagttctgcccacacctgggtgcccacctcccctccctgtggtctccaggagctgcccccaacatgccctgggcagcagtgctcatcgtagccccgtctgtggcctggacaggctctgaccactcctgcgttggcacagcttcctcgggaggctcctgccaacaccactcggcacggtgggctcaacacggcagcggcaacgggtgggagtacttgcctctgcctggcccgaatggcggttttccatttggatttggggatgagcagccaatgagcctatctcattcccgttaacgtgagagaaacatccagacgctatcctcaggtctcacacacccccgccgtgctctgcaccacatctggcaggggcacccccgactgtatgctgggcatcagctcccaggcccgagcgcctcacctcacactggggattggagccctcaggccctagagacactggcttgagaaacttttgagatggagtctcgctctgttgcccaggctggagtgcagtggcatgatctcagttcacagcagcctctgcctcctgcgggttctggaaattcttgtgcctcagcctcctgagtagctggaattacaggcgtgtgccacca

SEQ ID NO: 61173 - DNA, 498 bp, Homo sapiens
tacctccttggggccaccgttaagtgcagcagcagaaggggtctcgtgatccgggacacggggatgagcaagcatgcagagaaaccaacactagtcaggcagtcaagcattcaggaagcgggaggaagattttggaggtgaaggggaaagtgggatagagcggggaatcctctatggggatttctattgccagacagagctcttgtctcctcatcaagacaaagtctccttggagaagggatatcgatggctgcttaaacagggggaagagagagagcttagttgggtgttgcactgaattcagtgagggaggtgatcccaatgtatggcctggctaaggagtttccttaccccgagttgcatgagggggcttgtgattctcagatacggtgtttttaccttttactttttcctctttttaccaattacaaccttatagagcggctagcaatggcagtactagtaggaagataactagacctcactaagcctgcgtgt

SEQ ID NO: 61174 - DNA, 167 bp, Homo sapiens
cgccgatgccgctacccgctccgggcccctggcaaacccactgcttttcccctcctcccagcgcccgcgctgcccgccctgggcccgctgtcgcaggtgcaacggtaccaccaccccagctgtgaggctgccatcaacacccacatcagcctggagctccacgcatc

SEQ ID NO: 61175 - DNA, 338 bp, Homo sapiens
acccacacccaccatctccctttctctgccatcccttagaagctagagttcaaagcctgttcccttttccttcttgaacaatatctctggggtagcacctccttcccttggaacctcctgaagctcacgccaaggcctcgctcctgagcgcccagcccagccgtcctcacagcgggtcccatacctgccgcctcagtgccacctgcactggtgagagatgcgcctcagaccccagggacccagggattctccctagggcttgagaattacagacctcacaggaacaccagtgactgagctcttgtcttaaattgaaataaaattcacacaacatcaca

SEQ ID NO: 61176 - DNA, 335 bp, Homo sapiens
ctcaaaaagctgcataggccaggtgtggtggctcatgcctgtaatgagctcattccaggtgggctcattcccaacactttgggaagctgaagtgggcggatcacttgaggtgaggagttcaagaccagcctggccaacatggtgaaaccctgtctctactaaaaatacaagaaaaaaattagctgggcgtggtgctgcacccctgtaatcccaactacttgggaggttgaggcaggaaaatcctttgaacccaggaggcagaggttgcagtgagccgagccgaggtctcgccactgtactcctgcctgagtgacagcgtgagactgcatctcaaa

SEQ ID NO: 61177 - DNA, 240 bp, Homo sapiens
tcgagaaagtttcaatgtgattagattaaaattaaaagaatccataaaaatggaacaaagaagaagaggaatgaaattacttttactttaaatagcattgttatcacataaaacatgtatcttacaaattcatgggatagcccataaatgggactacagcaacaatggtaggagagtccatccttcttcaaaagcaacccagcaggaattttctgttcaaaatatttttcctgtcatact

SEQ ID NO: 61178 - DNA, 351 bp, Homo sapiens
ttctactctcttcttgcttagatgatttctgagaataagtcagatgtgattcttatcacagctcctctatagggaagggttttttccatgttgtttctcttaacattttttcttttactttgattttctgaagtttgagtatgatatgaataggtgtctcttttgtttttggcatttatactgcttggtgctctctgacctccacagattcctgaagatctttggtttggtgtctgatatttgtttgagaaaaattcttcatcattattgctttaagtattgcctctgtttcttgatctctttcttttcctcctggtatttccattaagcatatattataccttttgtagt

SEQ ID NO: 61179 - DNA, 393 bp, Homo sapiens
catctatagtccatacatatctataatggacagaaatatgagaatgaataagcaaagatacttatgtacaccaataataaagtaagaaaggtaaaaaaattcatgtaataagaaaaaataacaacccagaaatttaagaattaagtagtagtcaaatctaattggaataactcacctatataaaaaacaagaggaaggaaactttatacataggtctggaaaatatcacaactatgttcccagaagaatgtttatctccacagcatccaacctagtgtcatgcacacagttgggactcagccactgttgcctgattgataatgaagacagtcactgtgatcaacccaacagtaattgaacgttcatttttaataaggtcagtgtaaaatctgt

SEQ ID NO: 61180 - DNA, 8301 bp, Homo sapiens
cttagtgactcaagtgttccccttttcttggggatgagtaaactgaggctcattaaagagcttgtgaccaaacaacacaggtgccccagagaaaggtcgggcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttccaggtctgtgcagcacagtgtgggaccccaggagtgtggatctgtggaggcattgtatttggagaactccagcgacaaaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 61181 - DNA, 8199 bp, Homo sapiens
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 61182 - DNA, 8116 bp, Homo sapiens
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 61183 - DNA, 7658 bp, Homo sapiens
agaggaactctcatacactaagcaacatgatagtatcacgagcgaagtgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 61184 - DNA, 7188 bp, Homo sapiens
gcggcctgtgctcagtagctgtggcttctccatgcactgcctcgttagcatcttttgcccatttctctttgacttgcaaatctttttccatccttttagagttctttgttattcttggtgcttaccctctgtcagacttcagagtaacaaccgtcttctcccctctcgcagctcgcccctgagttaactcaggggcgagctgccagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 61185 - DNA, 3395 bp, Homo sapiens
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggctataattgatgatgatgttcagataactgaagacacaataaatgacattcagacatcaga

SEQ ID NO: 61186 - DNA, 2054 bp, Homo sapiens
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggtatggcctcagggctgggcccacacgggcactggccacgggggccacacacattactgcgcacatataccaaacacaggtatggcacacag

SEQ ID NO: 61187 - DNA, 1121 bp, Homo sapiens
agaggaactctcatacactaagcaacatgatagtatcacgagcgaagtgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaatagagtcaccgtttctacctggctccatccgcgaggagaacgtgtgtgtct

SEQ ID NO: 61188 - DNA, 370 bp, Homo sapiens
ctccggcggtccccacgagatcaccctgaccattaacaactccagcctgagccaggtcctggcacaggccgctgggcccactgccacgtcttcctcggggtctccacaggaaattaccctgactatctccggttagtaagttataattttaaacatcttttcaccctgcaatttaagtactgtatatcttactatctcttttcctacaatactctgctgtgcataaagcccgtgctcaatatgtatttataatttatgggagaaattgaagtttagtgaaaataatgtattctaattcagatctggcaccagaaatgaaaaattatagtttctcatgtcacttccagtttgagtacagtcagttatttaa

SEQ ID NO: 61189 - DNA, 8219 bp, Homo sapiens
cttagtgactcaagtgttccccttttcttggggatgagtaaactgaggctcattaaagagcttgtgaccaaacaacacaggtgccccagagaaaggtcgggcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 61190 - DNA, 8340 bp, Homo sapiens
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttaggaaatgtgattaatttttttcgtttgaaaatatttaagataaaacagtttggcatgtaaattaatttcaagttcagatatttttaagagaaaactttagtggtattttcctttacctctgtgaagttcagaggcgtttaccc

SEQ ID NO: 61191 - DNA, 7621 bp, Homo sapiens
agaggaactctcatacactaagcaacatgatagtatcacgagcgaagtgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgacgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacacacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggatggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggatatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 61192 - DNA, 3355 bp, Homo sapiens
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtagtgagtatggacagaggggtgcatacatggcagtatttagcaggtgctatgttattcttcactgtcattattaaaaatttccttaagggaaattttaagaggcatgctcacttcttgtagcattaaggttactgcattacctgggaaatcctcagtgtttagtacacagggctttctttttccttaaaacattttaattttgcttaaaggtttcactgccatggtgtggccttgcatttgtgattaaaaaccaaaaattgactagagtgctatgtaat

SEQ ID NO: 61193 - DNA, 2582 bp, Homo sapiens
cacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtaagatggattgtagggcgtctttataatttattgagtactattttctttgacattttgtgaattgtgtacacacattatggtctctgtagttaaatagttttttaggcatagtattaatgaagtctgtgttaagccttgttttgctttatggactagtatgttttacagtcaagattaaaatctaagttgtatccaaactactgctcaaattgttttctcggattagagacaaataatgtgtaagtgaaaacagtagcgtgtaagtcctcattgaagaaacattgctacctcagtggaaccatcaaaagtgagaaggggtttttatgtgaaacacacagtgcacgttgttgttttcatctttaggttctttgtactgtgttacagattatttgggctactttaatctttggatt

SEQ ID NO: 61194 - DNA, 824 bp, Homo sapiens
agcacattgccttgtttcattttcatcatagtgttattctactcttattttgatagttagatagattttttaatttttaattattttccctccactaaaatataagatcaatgagaacaagaccattcctttgtcatttttgtggcacagggcctaaaataatgattggaatataataagcagttaataaatatttgttgaatgaaaaaaatcatacatattcttagaagtgcaggaacttattaacccacccagggatggttcatctatggtgaactgcactcaacactggatggatgataatttataggaatctagtaattaataccagtttatgtatagtggtagacacaaatagtataataaaactgtatatgcaatacatttttttgaacattattgtgtcaaaaccccacatttatcaaagagccattgaagagcacatggaaactgggaaaaagagagatgggtgctattaaaaaaacacttaatcctatactctggctatacgttgtcttgtctgacaagtacattagctagtaaatgtttcttcttggtactgagaattatgagaggcagtatgaaagacttggttttgctagtccaaccataaaatcaacttaaatgccagcccaattgatggtgggttacattctacacgtaggcaaacagaggaatattaagttggtcttgcaggttattaaaaaatgaaaaagtaaaaatagaagataaaagggatggtttcaaaaaaatctgaagcaatggataagtatttcttaaagcccattgatggaaatgcagatttcctaagatctgagaaaaaa

SEQ ID NO: 61195 - DNA, 436 bp, Homo sapiens
atgaatggctttcgtctctgccactgtgaccagttcatttgtgttgtccaaaactgatggcttatgacagaggttggctggtgtgaactggccaggttatctgtcttcttggttgtttaatgcatcttctatggtggatgcacagtggccagttagtaatacgcttagcattcttcagtcttagtatccatttaggtcttggtattcctatgctcaattttgatggcaaatggacaaatgtaggaaccctggcttgccttggagagacatggtgccaggggcttgaccctccagaaatgacagtctggatcactccatcaggtgagctatgcagactagtgtagatgttagccaaggacgaagagaatctatagtggcagtagaagagatagatgatgtgtatcggttgtggtcacaaaatcagctgcagaagtaa

SEQ ID NO: 61196 - DNA, 846 bp, Homo sapiens
cagtcgtgtacaactgacagtgccatcatttactgcctggctcaggtcacgttactctaaggctttatttatggtgttacgaagtgggagcacaggaaaaggacaagggtgtctgtcagggatggcactgtgttaaaaagtgggcgtgcaagggccgcattcccgggcagccgctgcaacctcagcccctgggcccttacctccgcagcctctcccagcatccagctacccagactccaaggccccaggcgagagccagctctcggtacctggagctccacaggtcccagaatcggggtggatcagagttcaaattctggttctgctactgtctaattgcgtgctgcagggactcaatctcttcatctgggaaatgggagtaataacccttggcaggaatgttgcgatcctctgggatgtcagaggtgttgatgaatgttagttcccgggacttcggaaagaggtcccgttggaagagatgtgaattggaattcacaccctatattaaaatctcctccaatcttcacctctgagacatggctgtctcaagactgttttgtttcccttcctggtggaattttgcacttttatgtcctgtgtagcagcaggtagtgtggctttgagaaaataaaatggccaccttgctccgctgttctttctttgtaaaaaaaaaaaaaaaaaaaaaaaaacggcatagcaatcttggcctttctagctgtgtgaccccaggccggtcaatccctcctcctctccaagcctcggattcctcccctgagaagtaaagaaaataactcctaaactgcctcccgaggcttgctggcaggatccaaggtgtccagagatgtt

SEQ ID NO: 61197 - DNA, 1021 bp, Homo sapiens
ggacagtttctagcaaaactgcatgtttatggacctaacagtttacagtgattttcactgtcatactatttgcagtagcaaagactgaaaacaatttaattgtccatcagtagaggattgattgaataaataatgctaggttcacacaatggagtactgtgcagatgtggtaagaaatgaagagctctgcatcctgctatggaatgagctacagaatagagttaagtgagaaaagtgcattggaggaaagcatatgtagtattcagtaaacggaggggagctgtaaatgtatttattattatgttaaaaaaacaatggtagtataaaccaagaaaaagtttttaatgttatatatagaagaaaggaagaaataggtggaggagaggcagtgataaaagtgaaacttttctgcatataacttgttttatcctcttgaacaatgtaaaggtcatatattaaataaaattgttaaaaaaagtggtcaacttttttaaaaactcaaaaccaaaatcgaacagataaacccgtgtattaaattggtaggatggccagatggagagtgaatatttcaagtgatttaaaaatatttctagtggtatatactcgatgtttaaaaaagatatcccctccccatctcccagaaaacattttcagtaagcaaattgtgatgattaattttaggtgtctacttgactagattaaggaatatgcagatagctgttataacattatttctgggtgtatctgtgagggtgtttctggaagagattgacatttgaattagtgggcttttaaagaaaatgcaccctctgtgtagacaggaaccatccaaccagctgaggacttaaaacaaaaaggtagaggaaagatgaattcattctctcttctggagctggcatatccatcttctgtcattcattggtcatcagacctccaggttctctagctttggactctaagacttgcagaagccccgtggattctagggctttcacccttacactgagagttataccatcag

SEQ ID NO: 61198 - DNA, 475 bp, Homo sapiens
tatagaattatgtttaactttcttagtaataatagcagatggtaataaaggaatatgttcttactcttaggcaatcatcttactctacttgggctgtgataacaaaataccatagactgagtggcttaaacaacatacatttatttctcacagttctaggaactggaggtcctaagtcagggtgccagcatagttgaacttgggtgagggccctcttcctgaaagctgtagtctcagcttgcagacagctttgcctttttactgtgtcctcacacaacagagagagaaagagcacaaaagctctctggtatctcttcttacaagggcactaatcccattgtgagggctccacccttgtgacctcatctaaacctaattacccccaagtgccccatgtccaaatatcacatttggggttagggcttcaacgtgtgaatttgagggggaccccaataacaactgaagcagaatgcta

SEQ ID NO: 61199 - DNA, 186 bp, Homo sapiens
gtacccaagcaagccactcctcaggcattttccccacaactagaaatccagaggctttggatcttgagaagaacatgaaggaaagatgccaggaagtacagtctggtctgctgatgatgatcaatggaggaagtgtttcatggtggacatgggaaactggccagatcaactgctgtcaccttctaa

SEQ ID NO: 61200 - DNA, 368 bp, Homo sapiens
acagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatc

SEQ ID NO: 61201 - DNA, 468 bp, Homo sapiens
gcctggtgagttggaggcagcagctggttactttccatgcagagcagcttggagttgagtcactcgacaatccaagggcacctgtggaagcagccatgactcatgctaccttcagtttcacatctggaggaggaaatcactgacaaagcaaagcaaggcgacttctgggggctgccgtgtaggattctcccatgtttaaaaaagaaaaaaagattgtacaggatttaaacatagcatttattgcctgtgttcttagttataaaattaatacatgtacataataattgttgtagttagttattttattcagcatttatcctatgtcaggtactgatgcttcaagctttacatgcgttgtctcacttagtgtttctgaccattcagtgggggagatctgttattatacccattttacagatatggaaactgagtctatacacacacacacgcgcgtaaaacacatagaaa

SEQ ID NO: 61202 - DNA, 411 bp, Homo sapiens
agtggtacaggcctgtcattccacctacagagatactgagggcaggaggattgatacaggcccacccacagggttcaattgcccatggagtggtaacagaccaaaatgccaaaacagcagaaattgcagcagagaaagggttgaataagtcttgatagctaatggttaataatactgcattatatattgaaaatttgctaagaaaatgggttttatgtcctcttactataaagatcatagcctccaagaaatataggactatgagaaaagaccaaacctacatttgattggtatacctgaaaatgatggggagaatggaaccaagctggaaaacacatttcaggatattatccaggagaacttccccaacctatcaagacagaccaacattcaaattcaggaaatacagag

SEQ ID NO: 61203 - DNA, 542 bp, Homo sapiens
cctgcctggcaggaccatcagcagcaggttagagagcaaatgttcatgcagatgaggagcttcctcaggaatctgtggtctgtagatgccctcaagggtcaacatgtgctttctttgctaagatttggggatttctgacttcctgccagcttggtacggcaacaaggtgattctggctagagtctcagtagggctgccacctctcagcatggtgccaggagagggagccctggagtcatcagctctggacaggcctggaggtggcctttcaagtcctctgacctgcgcatcctgtgtgttgcaagtgaaggatctgacactagccttcattttcactcagtcatcaagctttctccatctccactgggtatagggtttggacactcagaaaggtacctccacctgggagacagcccaacttttctgtttccaaaaccaacatgaccaacctcccagatttgagacttcatgactcccttctctgtcaaccagcaccacaagggcatggttaacatttattaaatactcactgttctaaaaaa

SEQ ID NO: 61204 - DNA, 227 bp, Homo sapiens
acctaactgtcaaagcacagaaaatgttaacaaagtggttgggacttgccattttggaatagcacatttttagcaattaggttctctacactagagagccagtagactgatattctttaatgccagtttcctagttaattgtaaagatagacacaagttcccccctttataaaagcttctgttgtttcacataatgactttaactataatggaaatggggcaggaca

SEQ ID NO: 61205 - DNA, 420 bp, Homo sapiens
tgtcttcttttgaaaagtgtctattcatgttgtttgcgcatttttaataaggttgtttgttttttacttgttgatttgtttaatttctttatatattctggatattagacatttgttggatgcacagtttgaaaatattttctccccttctgtagggtgtctgtttgctcttttgatagtttcttttgttgtgcagaagctcttcaggttaattagttcctatttgtcaattttgtttttgttacaattgcttttggagtcttcatcatgaaatatttgccaaggcatatgtccagaatggcatttcctaggttttcttccagggtcggtctgccttgcctcgcctctcctctcctttcctctcctatctgtcctttcctttttcaattttaggttttacatgtaagtctttaatccatc

SEQ ID NO: 61206 - DNA, 2096 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61207 - DNA, 742 bp, Homo sapiens
cggacgcgtgggtcgacccacgcgtcgggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61208 - DNA, 1058 bp, Homo sapiens
  misc_feature (32)..(32): n is a, c, g, or t
  misc_feature (35)..(35): n is a, c, g, or t
  misc_feature (867)..(867): n is a, c, g, or t
  misc_feature (903)..(903): n is a, c, g, or t
  misc_feature (915)..(915): n is a, c, g, or t
  misc_feature (926)..(926): n is a, c, g, or t
  misc_feature (934)..(934): n is a, c, g, or t
  misc_feature (941)..(941): n is a, c, g, or t
ccaagataggctagtagggccggggtgtaatnggncgagggctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacggggtcgacganaggagtctggatggaagcctcccaaaaatggtgggngacatcgggaanaagcgtccagnaaagtcgnacctccnggagcctcgggttccacatccgtgccgccgcctcaatggacaaaccccggcgcgggcgacatggccaagcgctgccggggcgcacctacggaaacggcgcaaaagaaaggcggagga

SEQ ID NO: 61209 - DNA, 550 bp, Homo sapiens
  misc_feature (47)..(47): n is a, c, g, or t
ccagaaagccttctttataccccattaggcttccaggtggccaaccnaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61210 - DNA, 562 bp, Homo sapiens
gaagagaaggcacgcgaatgaagaatgatgcaggttggaactaaataaaaagtgggtcctagaagaacaagagataatccaggtgaaccggtatagagggaaaagggttaacacagcaaaaggatcttgggccgatgcagaagctgctaaagaaaaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61211 - DNA, 539 bp, Homo sapiens
cgctgccgaactgctgaagaaagaaaagatcaacagcgggcaaggcctcgtgcagggtcaccccagccccgataacggtcacctggtcatccttgctcgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61212 - DNA, 214 bp, Homo sapiens
atacattcctgagattctgggaaaggtgctcaaagatgtactgacccccgccccacacttcatacccgccctaggccttggtgatgaggcccctcacagcttgtgcaatgggtatgaagtgtggggcgggggtctatacattcctgagattctgggaaaggtgctcaaagatgtactgagaggaggggtaaatatatgttttgagaaaaatgaa

SEQ ID NO: 61213 - DNA, 2089 bp, Homo sapiens
  misc_feature (32)..(32): n is a, c, g, or t
  misc_feature (35)..(35): n is a, c, g, or t
ccaagataggctagtagggccggggtgtaatnggncgagggctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61214 - DNA, 2762 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaaaaaaaaaacaaaaaaaaaaaaaaaaaaaaaaaaaaacaaaaggggcgggcgcgcgcgccccataaatttcccccgcgggggcgccccacacttttcgcgcgcgtcccccaccttttttgtgtgtgcaaacaggggggcccccaatattagggaggactgcgtatatttaattagcgcaacggcgcgacggggcgcgcggcgagtatatcaaaaccaccagcgcggcggcggtcagcgggggacaaaccaccgctgcggctaagccggcggaaacacgtctgtgggcggggagaggagagacccccctttaaatgcctgcgggggggggggggggacaccacatcatatggttgcgggccaccaaacatctattcccctctaacgcagagaagctatatatacaaagagcgccctctaagagggcgatacatactatatatcaacgaattgtttcaacaaaggggcggtatcatcatagggggtggttgttccaaccacacaacccgcggccacaatatatgtgccgctcgcgccgggccccttggtgaaaaataatttgtgcggcgccacccacgggggggaaccatgcttacattctctgtgcggcaaccaaatttttttttatccccgagggggcctgcttcatgtactaatcatcaagagagt

SEQ ID NO: 61215 - DNA, 2523 bp, Homo sapiens
  misc_feature (2523)..(2523): n is a, c, g, or t
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaaaaaaaaaacaaaaaaaaaaaaaaaaaaaaaaaaaaaaagggggggggcgaaaaaaaaccccggggggggccccttttggggcacccctttttttgggaaaaggggggcccccaaaggggggggaattaaaaaagaaaaacggcgggccgcgtttaaaacacagcgtcggcgcgggaaaacagcgcctcgatggggatactccggggggaagacaccccccactgggcggcgccggcagcaattgcggacccccccccacggagaattagcggccgggcggccacaaccaacctacgctgcttatgggcaacccgcggcattgtcgcgcgagaaatgctccgcatttttgaaatatggagctaacgcaaccaacgcaacgagccgcaaacgaagagagaaacggcggacacagagtacacacaaagan

SEQ ID NO: 61216 - DNA, 2569 bp, Homo sapiens
  misc_feature (2569)..(2569): n is a, c, g, or t
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaaaaaaaaaacaaaaaaaaaaaaaaaaaaaaaaaaaaaaaaaaaacaaacgaaaagagaataaaagaaaacgaagaaagaaaaaaacaaaacaactaacacatgacaccgaagcacaacacaaccaccaccaacgggcgggcggcgccgccaaccaccacagcccgccgggccggggcccaggaacccaacgacaccgccgcacaggatcaggcaaaagcgcggccaacccaggggacagccgaaaaataatgaacgaacgacccgcggcgctctccaaaccgacccagcagacgagccaagccagccctgacgccgagacggagtcgagagagcaaccaccacaggtggggaggagacaaagggccaacacacaaccgacaggcaaaacgccgcgggacgacaccactgcagcggtcaggaccgcacccaccgacaaccgcccggagaacacctgaccagactgaaaaatagan

SEQ ID NO: 61217 - DNA, 2137 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaacgggaacaatgacaacaacacccccccccaaaaacccccgg

SEQ ID NO: 61218 - DNA, 2619 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaaactgacacaaaaacaacaaaaaaacaaacacaacaaacaaaacaaaacaacacaggggggggacggcctaaaagaaatcctcccgaggggggggcccaaacgtttacgcggagtcacaccgggattttcgtgggaaccagaggcgggcccctacagtagaggcaggccggcattaattagcgccagggacagcgcgaccggcgggtttacacaaacgtccgcggagcagcgggggaaaaactccgtctcccacgaggggaacctgttggagggagagagacccactaaactacgcagggaggggggcagccaaaaatattgtggggcgacaacacttaccccttacaaggaagaagttattaaagaacgccctactaagggggaaagatatatcaagacattcgttgacacgggcgtcaataaggggtgcttacacaataaaccgagaaatatgcaataacacggatgaagaacagttggtgcgcaccactgagagtctttgtattttcgcgaccaattttca

SEQ ID NO: 61219 - DNA, 2117 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaacacctttcccacgatctcagg

SEQ ID NO: 61220 - DNA, 2038 bp, Homo sapiens
cggacgcgtgggtcgacccacgcgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61221 - DNA, 1996 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61222 - DNA, 2057 bp, Homo sapiens
gggacaatagcatagaagcggtgtatcgcgaggcgcttgcgtagatcgcgctattcttgttcgagttcgccggtcccgctgcgacagagagtacaaagctacagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61223 - DNA, 2101 bp, Homo sapiens
  misc_feature (208)..(208): n is a, c, g, or t
gcgcctgtctgccgccgagagatgcgacgacagctatcatactagtgtgtacagcgatgtgcaccgcggtcactctcgctagcgagctcctactggagaagctaccagcaaagcctagtagccgatgcacgaacgtcgtcgtccgtgccttgaacggacaacggttcactctccgtcgtaacgtagtacaagcttccatgctacggcnaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61224 - DNA, 1586 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcgtagtcagatcgagccgcgtagtcagatcgagccgcgtagtcagatcg

SEQ ID NO: 61225 - DNA, 2123 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgattaacggtggccttctgttatgacagaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61226 - DNA, 1389 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctgtcgacagtcgcaacctggtcacagtctggcccaggta

SEQ ID NO: 61227 - DNA, 1976 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgattgtgggatggcctacaccggcaaatacttcgacaaggccaggggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61228 - DNA, 2030 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagcttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61229 - DNA, 2111 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagatggagtctcgctctgtcacccaggctggagtgcagtggtacgatctcggcccactgcaacctccgcctcccgggttcaagtgattctcctcctgcctcagcctcccgagtagctgggactacagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61230 - DNA, 1970 bp, Homo sapiens
gcgtggtgaggcttcagtgggctaatatgggtagtggttggcatggcactcagtttgagaagtgctatttttattcttatgtcaaaaagagtccccaaaaggatagcttttcaagagaaagggtgctctgccccagctccttcctgtatatttgactccatggttcatttcaaaaacatttccagcaccacatccagcatctgtggagtgatcaaatgtgttccccaaataagaattgggccaaaaaattcatcaagaatctaatagcagacagattccaaacccagtgcgctgaccccagaacagctttcagtaggaaatgagcagatcaggaatgaaagagacaataaaggaactgagctctggattacttaagaggaggaggaaaacctgttcagaggcaaacaaaaggaagtaaaataatgtgaaaaagaaaaggatttaaaaaacccaaactggaaacaggaatgttgcaagctttctactactccagctgaggccgcagttgtggggtggagcctgggcagaccccagctgccaaggcagacctttccctggaaggctcctcggtgttgtggcccctgggaattgccccttactctctgccccctgtccccagttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61231 - DNA, 1620 bp, Homo sapiens
aagcgtgccaagacctcaagggccgagggatcacgggtcagtatgcacaagccgccctcccgaagtaaaataatgtgaaaaagaaaaggatttaaaaaacccaaactggaaacaggaatgttgcaagctttctactactccagctgaggccgcagttgtggggtggagcctgggcagaccccagctgccaaggcagacctttccctggaaggctcctcggtgttgtggcccctgggaattgccccttactctctgccccctgtccccagttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61232 - DNA, 2017 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgattgtgggatggcctacaccggcaaatacttcgacaaggccaggggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaacgggaacaatgacaacaacacccccccccaaaaacccccgg

SEQ ID NO: 61233 - DNA, 1150 bp, Homo sapiens
gcgcatgcccagcctgcggatgttggcaatgtccactgagggtgcgtcctcctgtggagggattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61234 - DNA, 1065 bp, Homo sapiens
  misc_feature (874)..(874): n is a, c, g, or t
  misc_feature (910)..(910): n is a, c, g, or t
  misc_feature (922)..(922): n is a, c, g, or t
  misc_feature (933)..(933): n is a, c, g, or t
  misc_feature (941)..(941): n is a, c, g, or t
  misc_feature (948)..(948): n is a, c, g, or t
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacggggtcgacganaggagtctggatggaagcctcccaaaaatggtgggngacatcgggaanaagcgtccagnaaagtcgnacctccnggagcctcgggttccacatccgtgccgccgcctcaatggacaaaccccggcgcgggcgacatggccaagcgctgccggggcgcacctacggaaacggcgcaaaagaaaggcggagga

SEQ ID NO: 61235 - DNA, 942 bp, Homo sapiens
  misc_feature (26)..(26): n is a, c, g, or t
gaaaacttatgggtctaagtgttagncgagtgccctgcgcgggtgttgtttaacacttccgaggccacggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61236 - DNA, 1268 bp, Homo sapiens
gcgtggtgaggcttcagtgggctaatatgggtagtggttggcatggcactcagtttgagaagtgctatttttattcttatgtcaaaaagagtccccaaaaggatagcttttcaagagaaagggtgctctgccccagctccttcctgtatatttgactccatggttcatttcaaaaacatttccagcaccacatccagcatctgtggagtgatcaaatgtgttccccaaataagaattgggccaaaaaattcatcaagaatctaatagcagacagattccaaacccagtgcgctgaccccagaacagctttcagtaggaaatgagcagatcaggaatgaaagagacaataaaggaactgagctctggattacttaagaggaggaggaaaacctgttcagaggcaaacaaaaggaagtaaaataatgtgaaaaagaaaaggatttaaaaaacccaaactggaaacaggaatgttgcaagctttctactactccagctgaggccgcagttgtggggtggagcctgggcagaccccagctgccaaggcagacctttccctggaaggctcctcggtgttgtggcccctgggaattgccccttactctctgccccctgtccccagtgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61237 - DNA, 545 bp, Homo sapiens
gtcataccccttgtaataatggacttcaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61238 - DNA, 629 bp, Homo sapiens
  misc_feature (565)..(565): n is a, c, g, or t
  misc_feature (568)..(568): n is a, c, g, or t
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagtacgattattgntgnggagaggggatgtcggtcgtatggagccatagcttcgcaacatctatgctggctttggctc

SEQ ID NO: 61239 - DNA, 410 bp, Homo sapiens
gggtgtttacacctggagctcccttgacttttgcaccaggaggtatgggagggggatgggccaggattccagcccatggatgggggggtaggggtcttatttctgcatatcctttcccccacaccccaggggaagacgggccctcccagatggccctagaagatctggctatgtttcggtcagtccccacatcaactgtcttttacccaagtgatggcgttgctacagagaaggcagtggaactagccgccaatacaaaggtaggttgcatggctgttctttctcctgctggcagccatcacttcccaagggaaacagaagaggaggccagagctggtcacttgctgccccagggggtgtttcctgaccttgcccctggtgttcgtgtagcttgtggaagttagacaaga

SEQ ID NO: 61240 - DNA, 2899 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagccaaggtcaaaaaa

SEQ ID NO: 61241 - DNA, 2043 bp, Homo sapiens
agaaagaaagaaaaacatcggctagtgagcgcgtgttaattcggacgaggcgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61242 - DNA, 1748 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgatcactgatagagtctctcgacctcgatcgttgcttctgaacaatagacagatgagtcgcacacgcgtatactcatctcggggtattctatagtctcgctgt

SEQ ID NO: 61243 - DNA, 1826 bp, Homo sapiens
gctcggccctacgttggtcgcagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61244 - DNA, 2221 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagatggagtctcgctctgtcacccaggctggagtgcagtggtacgatctcggcccactgcaacctccgcctcccgggttcaagtgattctcctcctgcctcagcctcccgagtagctgggactacagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61245 - DNA, 1694 bp, Homo sapiens
cggacgcgtgggtcgacccacgcgtcatggagtctcgctctgtcacccaggctggagtgcagtggtacgatctcggcccactgcaacctccgcctcccgggttcaagtgattctcctcctgcctcagcctcccgagtagctgggactacagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61246 - DNA, 1532 bp, Homo sapiens
ataatccagccgtaccggactggagatgttggggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61247 - DNA, 1246 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacacgggtatgaagtgtggggcgggggtctatacattcctgagattctgggaaaggtgctcaaagatgtactgagaggaggggtaaatatatgttttgagaaaaatgaa

SEQ ID NO: 61248 - DNA, 1185 bp, Homo sapiens
  misc_feature (1069)..(1069): n is a, c, g, or t
  misc_feature (1076)..(1076): n is a, c, g, or t
  misc_feature (1092)..(1092): n is a, c, g, or t
  misc_feature (1100)..(1100): n is a, c, g, or t
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagcacccgnaggctangggcggcctggccagngggctgcngtgacgatctcgccggtgggggcccaaaattcccttttgggaactcaaagagcccggacgtccggggacatgcggcacacatggc

SEQ ID NO: 61249 - DNA, 1180 bp, Homo sapiens
aacttaggctaggtacgagcctgggttccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61250 - DNA, 1036 bp, Homo sapiens
cccggcgacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccttgccggcttccttctctgccctcatcgagaaatgtagccacagctcgacgcagggacggagaaggaagccggcaaggggatggggcaagcatgtctgtctctcaaaggctggccttcctggccgagtcac

SEQ ID NO: 61251 - DNA, 1276 bp, Homo sapiens
tttccaggtgcttggttgcccccaacacttgcggggcctgctggggaccatacatggccggagggaagaaaaaaccgtgggtttaactggcgaagaatcgcattcgactaatcgatccgaccttgttcatcattgatccagacccatagaagatcttcatccttcgtctgttctacaccgaatttgtgctttatcactgaagagtagagtaaagttgaagagttgtagttgtgctatttgggacagtgcctggtcacaggaacagatgatcttgctggtggagcagaggtcttacaattgaacctggtggtttgcccataggagggggaggtctatacgaccctggaggcggatacattccaggtcttgaagatgcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61252 - DNA, 728 bp, Homo sapiens
cgcgcggccccctccagccatcgcctacccttgggcccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaa

SEQ ID NO: 61253 - DNA, 1348 bp, Homo sapiens
gtcataccccttgtaataatggacttcaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagccaaggtcaaaaaa

SEQ ID NO: 61254 - DNA, 409 bp, Homo sapiens
cttccatcaggccagacacctggggtgttttctctcgcattccctttgtcttcaaggttgtgggaggatgagggaaggcgctcagggcctgcacgctccgctctgggttcttggatactgcgggcaacacagctggaccagatgccccagtgcaaggggttggcaagcatgagctcagccatgggaacgaggtggcaagtggttctccctgggacagggacaggcccgcaggctgagctcttagctacacgcagccctcaggatgtcccaccaggcccccaccagggcagatagtggtgcccagccctcccctcagccacgccgtgtgctctccctcacagaaaagatcaacatccgcgtgctggaccccttcaccatcaagcccctggacagaaaactcattctcgac

SEQ ID NO: 61255 - DNA, 301 bp, Homo sapiens
ccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaaggtacaaagtggggcctgtttctctgaacccatagttctcaggtttcccaagtctgtggcccagatacaccctctggagggctgggaaagggaggagagcgattcatttagggcgaggagtgatccctgaggtgttgttcctgtcac

SEQ ID NO: 61256 - DNA, 333 bp, Homo sapiens
tgggatggaactatgacagagaaagaacagggtgccttggaaatacagagaatgggagacacgactaatgaatgttcctacggttgtctatctctgagctttacaattcagtctctactattttgtgggcattttatgtcctatttataaaacctttcaattagaaattgagacatctattgagtacctaccatgtgggaagtgccctgcttgatgctgttgtatcttatgaagcttgcggaagagagtacggagttgaataagacacttttctttttcccacacagagtgcttaaaatctaataggagaaataagattacataaataatgaa

SEQ ID NO: 61257 - DNA, 448 bp, Homo sapiens
agccttcacccagtcagacttctgcacagagtcctgttataccgccactgggcaggtgatagtcgtagcagctaaagaatggggaacaactgggggtgctctgtggcgttgatgttaaagctacagagtcaggtttgacctcaaagcaatttcctaaattactaaatacacataactcttattgttcatgctttaatccatggtctttggcatattattggcctgttaaatgctaataaacctttgtttctcagcatgtagtttacatgatggggacttgattaagaaagtactttcaagcatcttatttcataggaaactttattagagataagataagacccattcaaatatgcattctcttaaaaatgggttgtgagttattctcagaattctctgctgtctgtcctttcctgtactccactttagctgtttggtatctctgttc

SEQ ID NO: 61258 - DNA, 1628 bp, Homo sapiens
  misc_feature (1624)..(1624): n is a, c, g, or t
  misc_feature (1626)..(1627): n is a, c, g, or t
cgcgttccagagtacccggtatagagaagtattctgtccccctctttgggaatggaaagaagccctgcctggatgcatggagcagatggatactgacaccaaggacattcagattttctttcctatacctattttcataaaatttggaaagaaaaactatctgcagtatttttttaaaacgacttctgctattcttacttagagaaatccagtgatagcacctcatgtcttcagaggagcaagaagttcaaggagttaaatgtcacattcatactcaggtaatagagaagaataaaacacatcaggtttgcttcatctatcctaagtggtgcttaggggttcagaaaaaatgtttcaagtacaggaaattaatgagcaatatttacaatgtattttaataaaagggatttttctagttaactctgagttaagcacgaactcctttcttttgttaattgttggaaataccattaagatgtatttgtctgtttttctgcattggcaagtaaagaacataaaacaaatattcccttggtgacagattatttttagtattttgggccatcttttgaatcactaataggtgagagctctaaagcatgctgcaaatagaagttcctttttaaaaatccctaatattagtattttccctgatttacctctttctcctaaaagtggaaacagcaaaaattaagttgaatataaatttaataaagctatatttaacccaagaatcacacaagccaggatgcttcttggtttaaaaatgtgaattaatcgactgtaaaggaactgcctcccattatctctgcactgagctatgaatcaaactttttttttttaagtagaggtcaaaaggagatgcaacttaacacggcatcagattgtaatacttagaattcaaccaaataacttttttttaaaactggggcttttctgtggggcaaggggacagagaagaatgggtggtagcaggagataaggggagaaaaggatcatatctctgtcagcccactccatttttttttcttagcacttcccatatttatcagtcttacagcttatctatctaatggctccaggctgaagtccaatctcagcattacagtttatatagcaaaaaaaattttccccaacccccttggagactctaaatctgacttagtagctagaaaccctgtaaatatggtcttagcagacattaagggaaacaaagccaaggcaacatgacaatgccaaatttgcaatttctaccaatccactaagctatcaggcctagttagtccatcattcctaactttgacatttctgaacgactggcattttctgacagttttgttgtttacctgtctaaaaactaagtacagttggctctgtatctgtgggtgttccacatccatgaattcaaccgtggataaaaaatattcagaaaaagaaggatggttgtgtctgtactgaacatgtacagacatttttcttttcattctctaaacaatagagtataacaactatttagcatttacagtgtattatgtatcgcaagtgacctagaaataatttgaagtatatgagaagatgtgtgtagattatatgcaaatacaacgtcattttatgtaagaaaaananna

SEQ ID NO: 61259 - DNA, 1742 bp, Homo sapiens
  misc_feature (1738)..(1738): n is a, c, g, or t
  misc_feature (1740)..(1741): n is a, c, g, or t
ataaaagtattgatggctgtgtcctcatctgcatttttgtttttatgatagggctgatattttcaacaacgaaacacccaatgttcagaccttacctcagtctaagagctggctccacagttggtagcaatggccctgttaggcagactgtccccctctttgggaatggaaagaagccctgcctggatgcatggagcagatggatactgacaccaaggacattcagattttctttcctatacctattttcataaaatttggaaagaaaaactatctgcagtatttttttaaaacgacttctgctattcttacttagagaaatccagtgatagcacctcatgtcttcagaggagcaagaagttcaaggagttaaatgtcacattcatactcaggtaatagagaagaataaaacacatcaggtttgcttcatctatcctaagtggtgcttaggggttcagaaaaaatgtttcaagtacaggaaattaatgagcaatatttacaatgtattttaataaaagggatttttctagttaactctgagttaagcacgaactcctttcttttgttaattgttggaaataccattaagatgtatttgtctgtttttctgcattggcaagtaaagaacataaaacaaatattcccttggtgacagattatttttagtattttgggccatcttttgaatcactaataggtgagagctctaaagcatgctgcaaatagaagttcctttttaaaaatccctaatattagtattttccctgatttacctctttctcctaaaagtggaaacagcaaaaattaagttgaatataaatttaataaagctatatttaacccaagaatcacacaagccaggatgcttcttggtttaaaaatgtgaattaatcgactgtaaaggaactgcctcccattatctctgcactgagctatgaatcaaactttttttttttaagtagaggtcaaaaggagatgcaacttaacacggcatcagattgtaatacttagaattcaaccaaataacttttttttaaaactggggcttttctgtggggcaaggggacagagaagaatgggtggtagcaggagataaggggagaaaaggatcatatctctgtcagcccactccatttttttttcttagcacttcccatatttatcagtcttacagcttatctatctaatggctccaggctgaagtccaatctcagcattacagtttatatagcaaaaaaaattttccccaacccccttggagactctaaatctgacttagtagctagaaaccctgtaaatatggtcttagcagacattaagggaaacaaagccaaggcaacatgacaatgccaaatttgcaatttctaccaatccactaagctatcaggcctagttagtccatcattcctaactttgacatttctgaacgactggcattttctgacagttttgttgtttacctgtctaaaaactaagtacagttggctctgtatctgtgggtgttccacatccatgaattcaaccgtggataaaaaatattcagaaaaagaaggatggttgtgtctgtactgaacatgtacagacatttttcttttcattctctaaacaatagagtataacaactatttagcatttacagtgtattatgtatcgcaagtgacctagaaataatttgaagtatatgagaagatgtgtgtagattatatgcaaatacaacgtcattttatgtaagaaaaananna

SEQ ID NO: 61260 - DNA, 420 bp, Homo sapiens
aaaaccaggagtccaacaaaagcctttacataaatcacagctgatacaatggctcttggctgaaggggagaggggcttagagtctcagcgctgctgaaagaaggtttgtgtctgggggaggaattgtcagagcagtccctggggaagagacgaggcctgatgtctgaacagagggtgagcccgtcatcctgctggggacgacagaggccatggaagggaatgagagtgaaaatctggaggcagactccagatgtgacatctccatggggcgggatggtccagatatctggggcctgtgcaggtcacgctccatcacagtccacagtccacagtccacagtctatcctggcagggcagtccctcctaggagggcatgctgtcttgcagaggtgccaggcaagggcagtcctcacccagtga

SEQ ID NO: 61261 - DNA, 2917 bp, Homo sapiens
tcctgaaggccgaaggtggctctagcgcatcctttgtcgcgccgtgacctgcaggtactgacagatccgtagggaggacaccgtgacttcccggacgctgggaaatggactcagtctcctttgaggatgtggccgtgaacttcaccctggaggagtgggctttgctggattcttcacagaaaaagctctatgaagatgtgatgcaggagaccttcaaaaacctggtttgtctaggaaaaaagtgggaagaccaggacattgaagatgaccacagaaaccaggggaaaaatcgaagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcactctggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttgattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaataatttcatttaataaagattgtcaggttatatttaataagaaagaaagtatcatgtaaacagcccagtaataaaattttacaatcttataaa

SEQ ID NO: 61262 - DNA, 2695 bp, Homo sapiens
caattcagacaggggagatatcctatactttttctgaaaatggttaaaatgtaattctcatacctactaataaatacaaaataattaaaaagccactaataatgtgctattcattttttacagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcactctggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaacttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttgattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaataatttcatttaataaagattgtcaggttatatttaataagaaagaaagtatcatgtaaacagcccagtaataaaattttacaatcttataaa

SEQ ID NO: 61263 - DNA, 2023 bp, Homo sapiens
  misc_feature (1213)..(1213): n is a, c, g, or t
  misc_feature (2017)..(2017): n is a, c, g, or t
  misc_feature (2019)..(2019): n is a, c, g, or t
  misc_feature (2022)..(2023): n is a, c, g, or t
ggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaaagcctcggtccggaagaagaagggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcccaccccagcaaggccctgccagcccacccaccagagggtgggaacctggccttgcccactagggagccattggaacatctgagtggcatgaaactcatcccccctgaaggacacaaaatctagggtggcttctgtcatcttgaagcccagttatctgtgataattccagcagggtaaagcgggagggtgggcggggtggtgcgagccaacccccctcccccaccctgccctgctcagggtgggaagggtaagtgggttccctgcattccccagccaccaccaggcctggagtatgagctcagcagatgtacttccaagggtggttgggtcaggtctcgaaatgaaataangtactgtgtgttgcagaaaactgccttcctttcttcttaatgtcacaattattcctattgaccctgttgcaggcaaaggtacacttgaccttgagacaagtcacacttgaccctttgagacagtccctttgtgagataattcagcattgcctttactgtgtcaattctggtagaagctaaggcccttgccctgtgagagttgtggaggcaaccctgggactctggtctgcccagcccaccccaggggcactgtcctgtgtgttctggaaatgcctctgggctgctgtgcaaaagcgcagcgtgcttgtgagtctcaggtggataactgtaggcagtcactaggcagtaagtggccgtggaggtggtgtctgctgtgcttaaagctccccctgcaccagcaaactcagggaaagctgcgtatttgtcttgcggttactggttaataacaactgatttcctcctgtcagacagcagaatctttctatcaggttagtgaaccttacggtttggaatctgtaatctgaatgtaacccagtttactttataaggtgtattcttaaattagtactccttgggaacagaattgccagacagccaactcagagtgactggtcaatggagaacactttgaacgagccatctttgcaatgccaaaatgtcctcccacaaggagtatgttaaatttggaatacccttatcgaatggaagttttcattggaataaattattgtagtttgtcctaggactttttttcatttcaagtaatttattttgctacctctttgaaaacctgcatgctcccancntgnn

SEQ ID NO: 61264 - DNA, 8770 bp, Homo sapiens
  misc_feature (4016)..(4016): n is a, c, g, or t
ggtaccagaaacgcgcgctgacgcagcagaagctgttcagcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataagataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattcncagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgtacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattgaa

SEQ ID NO: 61265 - DNA, 9608 bp, Homo sapiens
  misc_feature (1128)..(1128): n is a, c, g, or t
  misc_feature (4854)..(4854): n is a, c, g, or t
ggtaccagaaacgcgcgctgacgcagcagaagctgttcagcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcccaccccagcaaggccctgccagcccacccaccagagggtgggaacctggccttgcccactagggagccattggaacatctgagtggcatgaaactcatcccccctgaaggacacaaaatctagggtggcttctgtcatcttgaagcccagttatctgtgataattccagcagggtaaagcgggagggtgggcggggtggtgcgagccaacccccctcccccaccctgccctgctcagggtgggaagggtaagtgggttccctgcattccccagccaccaccaggcctggagtatgagctcagcagatgtacttccaagggtggttgggtcaggtctcgaaatgaaataangtactgtgtgttgcagaaaactgccttcctttcttcttaatgtcacaattattcctattgaccctgttgcaggcaaaggtacacttgaccttgagacaagtcacacttgaccctttgagacagtccctttgtgagataattcagcattgcctttactgtgtcaattctggtagaagctaaggcccttgccctgtgagagttgtggaggcaaccctgggactctggtctgcccagcccaccccaggggcactgtcctgtgtgttctggaaatgcctctgggctgctgtgcaaaagcgcagcgtgcttgtgagtctcaggtggataactgtaggcagtcactaggcagtaagtggccgtggaggtggtgtctgctgtgcttaaagctccccctgcaccagcaaactcagggaaagctgcgtatttgtcttgcggttactggttaataacaactgatttcctcctgtcagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattcncagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgtacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattgaa

SEQ ID NO: 61266 - DNA, 241 bp, Homo sapiens
actgccagtggatctgccactagacactctggcatggtttgggcgtctccctcgccttcctgggtgatctgcagccagctgccctgactcggtgacctgccttgtgatggttttctctgtgttgctgtttcagaagcccggagatcatgagcaccatctcaggtacacggagcacgacggtcaccttcactgttcgccccggcacctcccagcccatcaccctgcagagccggccccccga

SEQ ID NO: 61267 - DNA, 1327 bp, Homo sapiens
cacacttgaaagagattattgagagtaggttaaggtggttatattggggaggtgtggtatgtgtatatgtgtggatagtgttggagtgtctctaccatattatttgctaaggcggtgtacttgctgctagtctggtctctcaccttcatctacttaagctctgtgcattgatttttgggaccaccctatgttctgtcgtctggttggcatacaggctcgggaataaacagtttcagaaactggggcaggggaggtgacagctgtgtttttaagcatccaagtgtttctgagagaataaccatcagttgctgtcattcatcctgagagtatgaaattggaagctcgcttaccctggagtgtttcataacctttacctctgggaagtcaaggccgtgtcatcattaatctaccatcgcctgaaagcccccaggctctgcttttcatcctgccatcagtcacgtggcactgagattcaggctccctcttttcctttttgccatgctaccttacattcctttggaaatcagactggcctgagaactattaacatcttagtatggtaactcatttacaaaggggggcagttatttgtatttttgtgaaatatgacatcttagctctctgtcagcctctcttccatcactctagggaaaagacttttgagggggaaaataatagcagtacctgagctcccctgaaatgcttctttctgcttctaaggatttttctgactggactctttagattgggaatttctgcttctcacacatggtataaggagggatgataagtgagtgagcttgttacacttgaccaggaacagtgcctggcttggttaattcttttggtcgcagagaataacgatgtttcttatttgaatccagtgaaagtactcatgctttgtgttcttgggaattactgagttcaaattcctaatgatgcttgggttacactttgctttgtttctcctagtttctttttatatgatccggagtggcactggtaataagattgaagaaggtgggccgggcacagtggctcacacctgcaatcccagcactttgggaggccggggcaggcggatcacctgaggtcaggagttcgagaccagcctggctaacatggtgaaaccccgtttctactaaaaatacaaacaaacaaacaaacaaacaaaaaacagccaggcgtggtggcatgcgcctgtaatcccagctacttgggaggctgaggcaggagaatcacttgaacccgggaaggagaggttgcagtgagccgagatcacatcattgcacactccagcttgggcaacaagagcgaaactctgtta

SEQ ID NO: 61268 - DNA, 640 bp, Homo sapiens
ggaattctagtttctatggcttgcctcgagggcaaatgagggggtgagagacaggagagcaggagaaagtcagagagggactttgcttctggggctacttctgaagcatccactttgttgtattgtttcctgagccccaactagtctaactaaattcccacacgtcatccccactttctccgtatctgatgcctctgattcctgagccttcttaggattcagtggggtgaatgcatttgattctgctccgttctcccctctgccggaatttttgagtgtcagctttcctccttctgcctgagttcatctgtcactcttccatataccctcagtcttccagaaattactccatctttctcatctgctgggtctcctctccctttctcattgtccctgtgggttaacgttaactctcccagggccaaaaggatgacttgcacgtcttcagtttgcttacagggcaaacatgaaggcttaagaatcattcattgattggtttgcccatctccataatcattgaaatactctgccctttttccattttctcttgattgttgttggtgctattttttcttgattagtctcaccaggattcattaattttattagtcctttggctctgttgattctccccccattt

SEQ ID NO: 61269 - DNA, 302 bp, Homo sapiens
ggggagagtattgcatttctttatgaagaggtcattagtgaccttttaaaaagcaatttagtacagtgatgaggtgatactctatgaaatattaggtacctcagctggtttggtgttaaatgggaataaggataggacacatttaaagcatttcacaaagaaaattgacaggctttatttgtatacctaacacatgcttatagggtacataccagacactgttctaagctctttaaaaaattaaatcatttattttccataacaaccctatgaaataaattactattgatagatgggaatat

SEQ ID NO: 61270 - DNA, 5574 bp, Homo sapiens
ccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccaagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggtctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccaggtgcctgcctcccgtggcccaggcggggggagcagaggcggagtccccaggcccagcaccctccatggcaggtctcgtcctggaggagtgagccctggttcagtcacagagcctggctctgagccaggccctcctgctgcggcctctacctcagtttccccatctttaaaatggcccaatcttgtagctgcagttcacagaggtggctggggtcaagctcctttaggactgggtggatggagaagacaccttgtgctcatgggcccccgcctgcccacccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgtgcagaggcagaatgtgtactgcttggagcggcaggcagggcccgtggacgaggagcactgtgaccccctgggccggcctgatgaccaacagaggaagtgcagcgagcagccctgccctgccaggtggtgggcaggtgagtggcagctgtgctccagctcctgcgggcctgggggcctctcccgccgggccgtgctctgcatccgcagcgtggggctggatgagcagagcgccctggagccacccgcctgtgaacaccttccccggccccctactgaaaccccttgcaaccgccatgtaccctgtccggccacctgggctgtggggaactggtctcagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctggccccacgcccttcacccgcctcatcacccaagccaggcaccatgggcaacgccattgaggaggaggctccagagctggacctgccggggcccgtgtttgtggacgacttctactacgactacaatttcatcaatttccacgaggatctgtcctacgggccctctgaggagcccgatctagacctggcggggacaggggaccggacgcccccaccacacagccatcctgctgcgccctccacgggtagccctgtgcctgccacagagcctcctgcagccaaggaggagggggtactgggaccttggtccccgagcccttggcctagccaggccggcgctccccacccccaccctcagagcagacccctgggaaccctttgatcaatttcctgcctgaggaagacacccccataggggccccagatcttgggctccccagcctgtcctggcccagggtttccactgatggcctgcagacacctgccaccctgagagccaaaatgatttcccagttggcaaggacagccagagccagtgccccctccatggcgggacaggaccaatgaggttttcaaggatgatgaggaacccaagggccgcggagcaccccacctgcccccgagacccagctccacgctgccccctttgtcccctgttggcagcacccactcctctcctagtcctgacgtggcggagctgtggacaggaggcacagtggcctgggagccagctctggagggtggcctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagtccctgagacccagccgctggctcccagcctggctgaagcggggccccccgcggacccgttggttgtcaggaacgccagctggcaagcgggaaactggagcgagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcagccccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgtgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaaagcacagc

SEQ ID NO: 61271 - DNA, 1231 bp, Homo sapiens
aaggggagggccccaggctgcacatctgtgtgcccgatcacaccggattctgaatctcttgggagtcttctcatctttgtctggcttggcctgtctcctttcctctgtatctttgaccccatctggacttgtctttcaccagcttgcctttgttcctccctttctctgtctgtcccagcccgtggcagcccctggccatgccaccttttgcctggggcctgccagccttggcctctcgctggggttcttcagctattcccccgggctggggcgtgggcctggatgcctttcccgccacacacctcacggggtcacgcctgtgggcctgcacatggggatgtgtccatacacgtctctcggtccccagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcagccccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgtgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaaagcacagc

SEQ ID NO: 61272 - DNA, 313 bp, Homo sapiens
gtgagtgagctgggacatgtatacttggggcagtctcgggtggtgggatgtgcagattggctctagccttgccacgcacttgtctggtggctttgcccagtgcactttttctctgccagcctcggtattcacgcctgtaaagtgggagtgacaacgcaggcctcgttgatctctaggataacagttctcaaagtttaatgtgaaagccgggtggtggtgcacctgtagtcccagctatttgggaggctgaggcgaaaggatcacttgagcccaggaattcaaggatgtagggtgtggtgattgcgcttagctg

SEQ ID NO: 61273 - DNA, 3179 bp, Homo sapiens
ccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccaagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggtctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccaggtgcctgcctcccgtggcccaggcggggggagcagaggcggagtccccaggcccagcaccctccatggcaggtctcgtcctggaggagtgagccctggttcagtcacagagcctggctctgagccaggccctcctgctgcggcctctacctcagtttccccatctttaaaatggcccaatcttgtagctgcagttcacagaggtggctggggtcaagctcctttaggactgggtggatggagaagacaccttgtgctcatgggcccccgcctgcccacccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgagaagtggggcaggcacagccccacctgcaggggcttagtgtctggacagggacactggcttcagctcccagctcactgctgggccaccacgggtttggaagtttgcttctctgagcctcagttctccatctgtgagatgaggctagcgattgccctgtgtcccaggcccgctgggagggtacatggatgaggcaggtgggtgctggctcgcggcgcatgttcagtgtgctccagctcttggcgttctccctccaggggacacagctccccctcgatagaccagtccagtggcccctcaccacactgacttatttccctaaactatttataaaaagtagggcaatttcattaactctgactctt

SEQ ID NO: 61274 - DNA, 501 bp, Homo sapiens
gctccagaaactggggctctctgcttggtggggagctgctggagcctccttaaggtggttggcgtagggagccaggttctgggtaccccaagctactggttctgatgcctctctgcccccccactccaggctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgtgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaa

SEQ ID NO: 61275 - DNA, 1004 bp, Homo sapiens
ctccaccacgcgtccgcggacgcgtgggccggccgcggcggcgaggggcgctccctcttcagctaagccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagaaggagaaactgaggctatagaggttggagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcttgcgaaaagctacaaaaaaaaaa

SEQ ID NO: 61276 - DNA, 428 bp, Homo sapiens
gagatgggatctcgctatgttgctcaggctggcctcgaactcttgagctcaagtgatcctcccaacctcagcgtcccaagtggctggaactacaggtatgcaccaccacacccagcttaactgttctttcttttcttccatctctccaatcaggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactaggtaagtggttcatgctgagccctgcatatattatctatgactaaccccaaaacagacagctttcaggaggtttctctgcataagacaagttcc

SEQ ID NO: 61277 - DNA, 1648 bp, Homo sapiens
ctccaccacgcgtccgcggacgcgtgggccggccgcggcggcgaggggcgctccctcttcagctaagccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagtcctctgcatcccgccacaaaagcatcagttggtccagcccttcagcgggagacccccacaatcctctgtgcaatcctctgtctcggacctcatgtctcccttgcctgcgtctcaagagagctggcgacagagcctcggacctcaagtccctgtgctagccacggtagttcttcacaccccgtcactcttacggaattgctgatttcctctatttccttgcgtgatggagcagctctgctcggactgtgctccaggacagtgtaaatgccgactgaagatgccacagcagccggcgatgcatatttaaaggacagtctggagccgaaggtggcggccacgcttgtagtcccagctactctggaagctgaggtggaaggctcacttgggcccaggagagtccagcctgggcaaaacacagcaagaccatctctttaaaaaagtctaaaacaaagacttcatcttctcagtatttttgtgcaccaactcacactattttgaatagaagaactgagaatgggtgggaagagaatgggatctttttcccttaagataatcagggagtcccagagcagtatgcgttctcagcagccattttcagtggagcatttgactgtgcctcttatccctgactgtgaactccaaataggtcatggaaaataatcatccttagtggaagtcagattgaagctaagccagttttctttttacactaccttcctatctgcatgtaatttacaaaaaggaactataccaagccgccttccttataatgctgcagagattagataatgagataaatacaagtgctctataaatgctaaataacataaaaccagattctgtcacaaaacctaagaccacagtgatagtttgatggaggccgaggcgggcggatcacaaggtcaggagattgagaccatcctggctaacatggtgaaaccccgtctctactaaaaatacaaaaattagccgggcgtggtggcgggcgcctgtagtcccagctacatgggaggctgaggcaggagaatggcgtgaaccctggaggcagagcttgcagtgagccgagatcgcgcca

SEQ ID NO: 61278 - DNA, 670 bp, Homo sapiens
gttatgccaagtcatcagttatgctatagattatgtgacctgtcattatatgattaactgcctttgttttgcttctgtaagtttgcttataaaaatcctgcttagtctttgttcaaggctcagctttttggatgtgaatccactgagctggtgcgtaccttaacataaatatcctcctgttttcacccatgctggtctctctagtcctctgcatcccgccacaaaagcatcagttggtccagcccttcagcgggagacccccacaatcctctgtgcaatcctctgtctcggacctcatgtctcccttgcctgcgtctcaagagagctggcgacagagcctcggacctcaagtccctgtgctagccacggtagttcttcacaccccgtcactcttacggaattgctgatttcctctatttccttgcgtgatggagcagctctgctcggactgtgctccaggacagtgtaaatgccgactgaagatgccacagcagccggcgatgcatatttaaaggacagtctggagccgaaggtggcggccacgcttgtagtcccagctactctggaagctgaggtggaaggctcacttgggcccaggagagtccagcctgggcaaaacacagcaagaccatctctttaaaaaagtctaaaacaaagacttcatcttctc

SEQ ID NO: 61279 - DNA, 1194 bp, Homo sapiens
ctccaccacgcgtccgcggacgcgtgggccggccgcggcggcgaggggcgctccctcttcagctaagccgttagcgccgagcccgcccgggagcgggtcgccggccgcggcgggcgcccctgccagtgagcccctgtccgaagtgagccacggcattgactcggggctgcccgggggcagggcactgaggagggagttgcgcgcgcgaggcgagggcgatggggccaagaagaaccggggcgatagcgcggcagcggtgacagctgggacccgccgcggtcgggctgccccctcccctcgccccgaccgctcccctgctggtgagggcctgcggaggcggcggcggcggcgcccttggtggcagtggtggcggcggagcagcctcccgggatcgtgtccggagctcgaggagagggtggtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagagcagtcccctgtggggtgtgcagtggatgggagttggaagaaacagcagcctaatgttgatgacacagaggcacg

SEQ ID NO: 61280 - DNA, 4520 bp, Homo sapiens
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagggaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtac

SEQ ID NO: 61281 - DNA, 4919 bp, Homo sapiens
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataa

SEQ ID NO: 61282 - DNA, 313 bp, Homo sapiens
gtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggc

SEQ ID NO: 61283 - DNA, 5035 bp, Homo sapiens
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggactactgagtggtaccagcttgctctggttggtcttcattcctgagtagttccattgtcctgaatatttatttgcctttgctatagaattcgcatcccaatgatttcaatctttccagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataa

SEQ ID NO: 61284 - DNA, 4354 bp, Homo sapiens
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctgtgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgcgaccctgagattgccatactgtgaagaagcttggaatgaaaataacatgtcaagagagagtcccagccatgccagacatccctgctgaacccggcctcagtcaccgtgcctgctggatgcaatcacttagtgacccacgtgagaacagcaaaggaaccaccagctcaatccacaaaatcatgagaaacagtaaattgttttaagccattaaa

SEQ ID NO: 61285 - DNA, 664 bp, Homo sapiens
tcaaggagagctaaaccaccttttgtaatgtttggtttctcactgttatcttcctttcctataattaatttattttaatctacaaattgacatagggctaaaagcttcaatattttacaaaatattaattaatgtaattgttcccaattattagaaacttttttccatttttcaaaatgtttgccaacttcacacaagtgtgtaaaaatagggctctggattttcaaaagcacatacatgaataatttattagctattccaggcaagctaagtactagaataaactagataaaaacttggctttaagcatgtactttgatatttataaaacaaaggtgtttttttttcatttctgcatctgaatcaatacaaatttacacatgaagaattttggctgtaaattaaaattttagagatttttactactgccctcacctctgcctcctcttaactgttctcttccttactctccctctcttaacactttctctcaaattaattatcttttagttagtgatgacattatttttcccagctggtacaggtaatatttctcacaaccaagccttaatcatttttaaaaaatacactcaactctaattctggcctaaatattatttttctgaaaaagcttctgatttaagattgattccaatagacacta

SEQ ID NO: 61286 - DNA, 2708 bp, Homo sapiens
  misc_feature (2707)..(2707): n is a, c, g, or t
gggagcttgtctgaggctggagctctattgtctgaatccaggggcagaaagaactgagggctcttttacggcatccacctggaggctgcctgcaggcttgggttgctaagtgcactgcttaatttagaagcgccttttatcctggctctcttgaccagtcaaagttgtggtcgctgttttctacaaggactggggaaagaaagggtggaattaattaaacctggaggaagggactttgaagggcggagctaaggtcaaagaaagaaccctttaaataaagggcccacactggctgccagggagtgcgcaggactggcaagagggaagccgggctgctccacgcctttcacgccttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagcagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaana

SEQ ID NO: 61287 - DNA, 3533 bp, Homo sapiens
  misc_feature (3532)..(3532): n is a, c, g, or t
gggagcttgtctgaggctggagctctattgtctgaatccaggggcagaaagaactgagggctcttttacggcatccacctggaggctgcctgcaggcttgggttgctaagtgcactgcttaatttagaagcgccttttatcctggctctcttgaccagtcaaagttgtggtcgctgttttctacaaggactggggaaagaaagggtggaattaattaaacctggaggaagggactttgaagggcggagctaaggtcaaagaaagaaccctttaaataaagggcccacactggctgccagggagtgcgcaggactggcaagagggaagccgggctgctccacgcctttcacgccttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagcagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtaagtatcttccctctgtggctaggaagacaaggaatacatttttaaatgtctcctaaagcaaggacctgaaaccagctctatgggattattcttgttcctctttggtcaatgcagagacatgggaagaaccaccaaaggtcatgagggtctcttccagggatccctggacattgcctttcccagtggtgtgacaagagttagaggtggcctaccttgcctcctgtcctaggaggcgacagtaggagagccttcggttttctcatcctcttacttgtatgttgaactttacttaatgcaggctatatccaaaatacagtgtgaattaggctagaatagaaatgctttctattctaccttcagaaaaggaaaagggtagggtaggggaaatcatgggagagattaaaggcagagaggaaacccagatgggactgtttaatccccaagcaagaaaccactaggaaagagagataccttccctctaacttttgtattcggtgcactgacattgctctctgtgctggtgggaaattgatttctgtgccaggatgttctaggctgaggccaagagggtgctggccctttacccagtggaagaaaaaggcaagggtgaggctttgtagactttcccattcggaggtaatgatgcctccttcagccccacttcttcaaactgactccacctgctcccatctccacacccctccgtttctcatttagccaaagcacatcatccttgcagcccaccactcagcttggccaggtgcgagacatctttccccacttcatacctcccctccggccaggtgatgtttgcctcctcaggtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaana

SEQ ID NO: 61288 - DNA, 260 bp, Homo sapiens
gaaaatgttaagactttgaagtctcaaaccttgagtttaattttaaatgaaagatcttgtgagtacaatatgttatgaactatatagataatttattgagagaactgtatagaagcccataactctttttatcatttgttcattgacaatatttattgaatccccatatgtcaagcacagtgcacattacggatttagggatgtggtggttagtaaaacaggtacggtttctgcttttactaaatgtgcagtctagtgca

SEQ ID NO: 61289 - DNA, 292 bp, Homo sapiens
  misc_feature (285)..(285): n is a, c, g, or t
  misc_feature (287)..(287): n is a, c, g, or t
ggaggcacaagagcccaaccaactgtcccatttttgccctgacctttgccctggtagtcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggagcatcaaccgtgctatgcatgaacacaccccngnggtac

SEQ ID NO: 61290 - DNA, 1007 bp, Homo sapiens
tgctgggattacaggcaggagccaccatgcccggctgagagcagagattttatctgtcttgttcattacagtatccccagtacccggaatactggcaggcacacagtaggtgctcaatgaatgaatggtcaggcactaaaaagggctcttccccaaccactgatcatttattcctccattcatccccagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaagtcccgcgtggtcatgcaaaatgaaaatgagaggaacttccacatctactaccagctgctggaaggggcctcccaggagcaaaggcagaacctgggcctcatgacaccggactactattactacctcaaccaatcggacacctaccaggtggacggcacggacgacagaagcgactttggtgagactctgagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggagcggccatcaaccgtgctaagcagtaaccccacagaagagcgtc

SEQ ID NO: 61291 - DNA, 1072 bp, Homo sapiens
tgctgggattacaggcaggagccaccatgcccggctgagagcagagattttatctgtcttgttcattacagtatccccagtacccggaatactggcaggcacacagtaggtgctcaatgaatgaatggtcaggcactaaaaagggctcttccccaaccactgatcatttattcctccattcatccccagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaagtcccgcgtggtcatgcaaaatgaaaatgagaggaacttccacatctactaccaggtgcagggaaggggccgggggagagggagcaccacctggagcccagcggggtggacaatgggaagctgctggaaggggcctcccaggagcaaaggcagaacctgggcctcatgacaccggactactattactacctcaaccaatcggacacctaccaggtggacggcacggacgacagaagcgactttggtgagactctgagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggagcggccatcaaccgtgctaagcagtaaccccacagaagagcgtc

SEQ ID NO: 61292 - DNA, 432 bp, Homo sapiens
tgctgggattacaggcaggagccaccatgcccggctgagagcagagattttatctgtcttgttcattacagtatccccagtacccggaatactggcaggcacacagtaggtgctcaatgaatgaatggtcaggcactaaaaagggctcttccccaaccactgatcatttattcctccattcatccccagtggagagagtggagctgggaagacagtggcagccaaatatatcatgggctacatctccaaggtgtctggcggaggcgagaaggtccaggtgagacgaggaaaacagaaggataagctgggtcgccctcacctgcatggtagtgcagccccacccatctgcactcctgcctcagtctgacttcttcccactccacctgcctctgccccagcacgtcaaagatatcatcctgcagtccaacccgc

SEQ ID NO: 61293 - DNA, 122 bp, Homo sapiens
atggccagatatgggggcctgttcccaacactccagcctgtgtgaagcccagagggtttggcatgggaatggctgcagtggaacacagcaagggacatccatccctcaaagcttgccatgtt

SEQ ID NO: 61294 - DNA, 434 bp, Homo sapiens
ggtatcaggaatcaaaattaatcagggatcttttcacactgctgttttttcctctttggtccttctatcactaaaactcatctcattcagccttacagcataactaattatttgttttcctcactacattgtacatgtgggaattacagataaacggaagccggctggggtggtggctcacgcctgtaatcccaacactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgag

SEQ ID NO: 61295 - DNA, 566 bp, Homo sapiens
gtgtggagtagctactgacagcacacccccaaccccacctgccagtccctccttttagtaaagcttagcacaatggagggggcaagaagaccaagatggagaaactgagtgtgatcccccaaaccacataagagatccatggctcactatgctgtgcacacacccaggaagggaatcctgttacaggacggggaccaggccctgtttccaacagtggcaccccttcccttggtatcatggcagggcccttgctgctgaggactgatctttgcatcctagacttgctccctggtacagttttacccaacccttgtgcaccagcacctcgtgacagggtcgtgtctgcccatccacccttttctgccccaggatgagacctggaagccaatcaagtttatctttcattcatccatccacttcttcaataaacattgaagacttcttatgttgccactgccccctccctagagccccttgcctgctcagtggcacccactaccctccttctctgccttgtgtcagaatctgctctcaggaaagaggttgataaacccatttgcactgat

SEQ ID NO: 61296 - DNA, 5558 bp, Homo sapiens
gcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcaggtgagtctccttgcctctggcccagaggcccagcagcccgaggggccatgcctcagggtggcagaccttggcaggagagcccctgattgactcaaataagcccttcagagcgaggatctgtggggagggggagcaaagtctacatctaggtcaagccaattattctgcccatgaggaaatacttctttgggtaattatttgtttaatgccatcctgccaggctgtgagctccatgaaggcagggaccacttgtcttgttaacactgtatccctagctcctgacaaccaccacagttcaaataagtgttagcttttactgacagtctgtgctagaagtttgaaatagatcatctcatctaatcctcccagccacccagtgacgtgggttctagtactacctccattttataagtgagtaagctgaggctcgctgaatctaaagaatatatgtcagatcacacagctgagaaggggtggagctgggattcaaacccaggtcagtgacttctaggcccacagtcttaacccagcacatagtagatgttcaataagtatttcttgactgttggcagactagggaaactgagctccagacacagtgatgtccaagctggcatgaccagcctcacgtgagcactgctttttccattgatccgacactctcacccacactgtcaccactaatcctgggagacaggtcagggtcaaggaagaaagtgatgcacagagaggtggagtcacttgctcagggtacacagcaaccagtgacagtggatttccagaatccagccagctctcttctgtgctactcccttcctgtcttggagggctccctcaccacccagggaatgggacccaaggcccagaggctgctccagcacttcccctgctcaccctcctcagaagccctccctgtgcctgccactggctagcctgcctcagtcggtgcaagcagtgaggagggtgcctgggtctctgatttggcctgcatggttttcctcctacccctttttctttgcttgggtcagcacgttttttaaaggatgaacagcagtttgctgtgccattctggaaagcagccacagcctctccctccggcctgtgtgtgtctgagggatctgtgtgcccagcccacttgctggacctgtgggacactttaagcgcttttggatggtggggggatgcagcccaccctcggccctgccctgcagtggggctggtgcagtgtctcctgcacctagagcacccacctctctgagggcaaatccttgagcccacgcccaccccctcccactgaggaattatctccgagcaaagcctccactcaattgcccctctggggctgaatcacacatttccccctttgtgctgacccagcctacggggtgtgtaggtatctccttggccccattcattctgcccctgcaagtcctgccaggctcccgatggcattctgggtgcctgtgcccctcttctcccaggaggacaggatgagccagctatcccactgccaatgccttctggaatccgggccgtccttcttggtcccctgctggtcctatttccaaggctagctgggtttcctgtatccgagaggctcctgtgcctcagacctggtgtgatggagtcagcaggccccagctcagtcttccctccccctcccttcactcagtctcctcacttataaaataaggggctccctcccctgcttacctcacaaggaatccgcaagaaccaagatgtggagatgggacagtgggtgatgtgacattgtttctcagacaagcccagaattgagtggcctggagagtcaagaagccctgagattgtgcctaatagcactgataagaagtgagaatcccgctgtttggggagcacttcctaatgattgggtgattcagtcattcgttcatcttaaaacaaaatgacggctgggtgcagtggctcatgcctgtaatcccagcactttgggaggctgagatgggtggatcatgaggtcaggagttcgagaccagcctgaccaaaatggtgaaaccccgtctctactaaaaacacaaaaattagccgggcgtggtggcgcgcgtctgtaatcccagctactcaggaggctgagacaggagaatcgcttgaacccgggaggcagaggtagcagtgagccgagatcgtgtcactgcactcctgcctgggtgacagagcgagactcagtctcaaacaaacaaaatgtcactgggtgcctaccttgtgccagagaatgtacagatcatgttggccacaaggatgaacggacatggtccttgacccccagggaatttgcactttagtggaagagaaagaagggagtaagacactatattacagaaggctagatgctgaggtagctccaagcaccacgactccctggggtgaggatggccatactctctccagctgggcattgctggaggtttggcctacatgaggtaaatgtcaaggactagaagagcatgaagaaacaggaggggggatccaaaggcccttgacctttaggctctctgcgggggccatgtgggcccagagaggctgggtctcagccctacccatcacgtccttgcattcccactgggagcccaggctccgcccctgccttccaccctgtgtgcacatccccccgcagccctagccctatccctgcagctgggtgggctcatctctctcccctcagctgctccctgtccaccaactgccctcagagccctctgggcttcctccacatggtcacaagcactcctgcctctaatcgaagacacggtgaatgagagaagatggaagaggggaggtggttgcaatgggaggcaaataggagagaaacccaaactagacctatcttactattattcttccctgagccttgaaacctgggtctctgcctctcatcccttctcataaatgttccaagcaacactccatcctccacccaggcacttccgtaatgttctacaggagcaactcttctcccccttgtcaaacccggggtcggggaggcaccaggaggtgaaggcactgaccaggagcccctgcatgactctgtgatgcgagacctccagtctcccaccaccctgctggccccacacttcatccctacaaagaaggcagcttcccactagggggtgtagattactggcctcacaggtcagaagcttaggaagaataaatcttgtttacagaaataaaagatttacctaggccaggactgacaagctcaagtgcctacagggagctggtgggaaaaccccaataggagaaaagtcgggaccaggcaggaactatggtgacctgcagaacaagagccccatctaaggcagagggcaaatcctcagccccagcaactgatgccatgtaagaaactgggtccaataactacatagaagctggaaatgcagatttgcacgtggcaaccaagctaaattgtaaataaacacaggggacttctgctttgcctcctcctctgatctggacaggaacttctgcaaactacagaaaagcaagagccctgctgggaagggcagggcttaaagctggtgttagaggcaggatgggggcagcctcttacataggaacacacagcctgatttaaatgaggggcatgactgggcatggtagctcatgcctgtaatcccagtgctttggaaggccaagacaggtggatcacttgaggtgagacgttctagctagaccagcctgggcaacatagcaagacccagtgctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtcaaaaaaaac

SEQ ID NO: 61297 - DNA, 439 bp, Homo sapiens
  misc_feature (385)..(385): n is a, c, g, or t
  misc_feature (400)..(400): n is a, c, g, or t
  misc_feature (425)..(425): n is a, c, g, or t
attcggcactagggggaagcctcctgccacagcttaggacagaactgggcccagggaaaggcctctccccagaggatggactagaaggcctgggcacactcgggcatggacctttggggctggggagcaggggctgcgctgttgaatgtaagagccaagtgtctgtggtccgcagcacctgctctggagggctctccagcagtttcgcctcctgactctcaccagcgtcctctcggcagcactcccgtgcccaagcgcacccctctggacttgccagcgcaggccccttcgctcccagggccatgctttgcctgtcctctgtcgtgatgtttcttccgcagccaggtgcagcctcagatcccctgttcatctgggaagcctttgntgtgggtcagatcanggtctgcaattattcagccggttcnttttgggcaaggag

SEQ ID NO: 61298 - DNA, 1966 bp, Homo sapiens
gcccggagaaagcaaggacagaagcccacacaggggtcttttgggtcatgaggcccagctgtgcaggcaggcagggccaggggaaattgggcagcatggatggagaggctgaaggctgggaagagggaaggggagaggggcagcctgcaggggtagctgaagaacaggaaggaggtgagaagcccggtgacctgtcagagatgccaagcccagggtggcactgggttgggtggggacggatggtgtcttggcagcaaaggatgggtaatttgcaaatgaacatggatagaagagcagcaaagcaccaaaagaacaaggtctcttacccaggacacagtcccttccacactttaccagccccagggtctgagcccgacgctgcctcttccggtcctgtgcctgtgggtgcccacattcttagcaagaggctgcagagggatctttaggggaagattcgggcgtagtttattaaacagactccacttctatttggccatgtgtcaggctgagacctctctctcgggcattaatgaacagctagtgccctgtccctgccgccaggacccactgaaaggacgggtagccacacacatccctgagtagtcccagcctcatttgtcatttttgactcctgctttctcaaaggtttttgcctctgtcaatacagcatcatgggtggttggaaagaagggaacttcccttctggaccaagaacagcccctaagtcattagggttcaacctcacccttattcccctccccgctacaggagcccctaagtcattagggctcaacctcacccttattcccctccctactacaggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctggggcagatatacctaccacaggagccccctgtctttcataggccaaggatccacatacccatagagttcatggattctagagggtctaggaatctcttgaaattgtccctaaaatactgcatgtgtgtgcatacatgcattttcctggggaaaaagtccatggcttctaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagcgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagcaggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtcaaaaaaaac

SEQ ID NO: 61299 - DNA, 2940 bp, Homo sapiens
gcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctggggcagatatacctaccacaggagccccctgtctttcataggccaaggatccacatacccatagagttcatggattctagagggtctaggaatctcttgaaattgtccctaaaatactgcatgtgtgtgcatacatgcattttcctggggaaaaagtccatggcttctaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagcgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagcaggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtcaaaaaaaac

SEQ ID NO: 61300 - DNA, 350 bp, Homo sapiens
gggcttaaagctggtgttagaggcaggatgggggcagcctcttacataggaacacacagcctgatttaaatgaggggcatgactgggcatggtagctcatgcctgtaatcccagtgctttggaaggccaagacaggtggatcacttgaggtgagacgttctagctagaccagcctgggcaacatagcaagacccagtctctgcaaaaaatttaaaaattagctgggcgtggtggcatgcaggtgtagtcctagctactcagaggctgaggcaagaggattgcttgaactcaggagttcgaggctgcagtgagctgtggtagcaccactgtaagaacaaggtcatgcctaa

SEQ ID NO: 61301 - DNA, 2501 bp, Homo sapiens
gcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacgggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagcgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagcaggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtcaaaaaaaac

SEQ ID NO: 61302 - DNA, 321 bp, Homo sapiens
ccaggcactcaggctggctgtcccttttctcctcctgcccaccccatccactctgagcatcaatgcagccggccagttgcaggcaaccaggcagcaccctggctgcccaggcaggctaagaggcccccacccactcccccctcctttgccagtggaaaagcttgccgtagggcatagctttcccagccttccctgcttcagaggcaggagcatggcactctgggagttgtagtgctcataacactcaggcgatccctgtgcaaataactggagagaggactatggtatggggaagagaaatgagaataagcaggagtggct

SEQ ID NO: 61303 - DNA, 516 bp, Homo sapiens
aagaccccctttattaaccctgtactggcacttaaaacatactctattgtatttgccagctccttggcctgtctgcaagttccttcaggcatgctgccatcattctcatttatcactgtatctcctgtgcccagctttaaaaatattaggtaaatgagtgaaaaaagaaaatgtactatagttgcctctgttagaatgtttttctcccatgcaattccagatctacaagcagacctgcttattgagtttattgaatttctacctttttttctgaaaatcagaatatctcagggtccataaatctgtgagaaactcgtgggaagcagagcagcacataacagcaagatgattttccccttccttttgtctttaggggtcaagaattcttgtctcatggttcaggcattgtgttaactatttctgtgcattctttaagcatagttgtaactgtagttttgattgaaatattaacctataagtgatttggaatatcaaaataaacattcatatcacaga

SEQ ID NO: 61304 - DNA, 344 bp, Homo sapiens
agctagagtagctgctgggaagtatttctctcagtttcccgggagcagtgtgggtcgtgattctggattggccctccagggcagctagagtagctgctgggaagtatttctcagtttcccagtgcaccccatgtttctagtagaaaacacaattggtaattaaatattggaagtagtttctaacaattggatactcacctgagaacataaatttgctctctgaaataagcggtgggctttaaataattgcctttgtgaatatgaaatttaagtattagatgcacgattaggatcgattgtaacaaaacagtgatatctaaaatataccttcatgttttcaaagt

SEQ ID NO: 61305 - DNA, 599 bp, Homo sapiens
acaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacacttgtgcaatgcatgaatgggagaccctcagcttgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtat

SEQ ID NO: 61306 - DNA, 392 bp, Homo sapiens
tgagccatcgcgcccagaagagcttattctaaaattgaacttcttgcccctctaagtactgtcatgccatgggtggagaaatttaggaaagttctggaaatccctccctaaagaatttcaaatgtgtaagaacatttaaaaagtgttaaggcaatttaagtgagttctgagtaattggtacacaagaagctgttattactgctcatcttgattcaaacattaagcgaagaggcttacaagtaaactcagaacagtgagataaatgataggccaaaaattccaggaactgctgagtcaggagagcgtttttcaagacatctggccccaagaaaatctacttaaagcataaggagaactggctgacaatttctgaacccctggtgattatatgt

SEQ ID NO: 61307 - DNA, 422 bp, Homo sapiens
gatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggta

SEQ ID NO: 61308 - DNA, 393 bp, Homo sapiens
gatcagtatagatgaatgtgcagcaatttgctgactagtaatatgactcacgtaggtgtactacatacacccttctgctttcctatgaccggaattcatctctagagaccaagtttctcatttcggtttcacatttgccaataaaaggatagcaacactttcctaaagcaagttgctccctgccctgcttaaagcctggggtggcccagtcatggcaaggaccagcaggaaaagctttcttgaaaactgcttgtgcttgcaacaggcagtttcgcagttgatcccttcatagttttcttgctgattttgtgaagtgtcaggcattgctgatggcgtcacacagcttttttaaattgaggttatttgtatgaacaatattttatagtttgatgg

SEQ ID NO: 61309 - DNA, 481 bp, Homo sapiens
tgttacatactgatctacactttaaaataatatatatactgaaatctgtattcagatctcattgcaagcaaatatagatgaataaagacccagtctctgatataccaagcctcaaccagccctaacaaatgctgcttttcgacgggcaggtcaaaagcttgcctccatgatctgatgtagaattcatctctagagaccaagtttctcatttcggtttcacatttgccaataaaaggatagcaacactttcctaaagcaagttgctccctgccctgcttaaagcctggggtggcccagtcatggcaaggaccagcaggaaaagctttcttgaaaactgcttgtgcttgcaacaggcagtttcgcagttgatcccttcatagttttcttgctgattttgtgaagtgtcaggcattgctgatggcgtcacacagcttttttaaattgaggttatttgtatgaacaatattttatagtttgatgg

SEQ ID NO: 61310 - DNA, 243 bp, Homo sapiens
gtctcaggttttttcatctgtgaaatgtgagcagaaaccccagcccggcatacctcctacgggtaggttgtgatcctgatgtgatcctcaacaagacctggagatctccaggtctggctggggggatgaatctgcgagagacaccatcctggcgaggagtttcaataaatggctctgctgggtcgacccagcaagtacagggacaggacacacacccaaagagaagagaagcctggagtaggg

SEQ ID NO: 61311 - DNA, 216 bp, Homo sapiens
tagcatccaggggaagttcaattaatatttgtgaaaaatactgaaattaaagagacaagtagaagaaaatgaaataattaagtagattgagaaaagttgccagaaagcttggagaaaaaccaagatatgtaatttttgcagaagtcaaaggtagaaactattctgagatcaaagtcctataaacagagtcaaatgcttccaagaggtaaataagag

SEQ ID NO: 61312 - DNA, 374 bp, Homo sapiens
aaatattaatttttatccctaatgccagaaaaatacactgctatggcatttcaaaattgtagccatgaaatagaatgagatgtgatgtcatcacgtttttaggataatttctcactgccactagaaaaatacttcagcagaattcatgaggattatgtatattttataatcagtctcctcctaccatttatggtgctctttagaggtgataattctgtcttttgaagatctctggatcacaggaacaagagtgatggcaacaccaagagcaagccagggccctcctgaaactccccccttcctcactcactcttcactgcagcctctgagaagggaccttggccctgtaccaacttccttctccatccaaagtg

SEQ ID NO: 61313 - DNA, 248 bp, Homo sapiens
gaatttctcttgatttatttctcagtttgggtttgtgcttttgaaaaaggaaaataatgatcctgaaatcagtaggctttgtctttgccaaaaaatgtggacatgttgatcttaggggggctgattatataaaacaatagaaatgtagtcttagatgaaaatctgtaaagatgtaagaatgctgaactaacatgaaaatcaggggctgagaaaatgctggattgagaataatgtgataatgaaggttt

SEQ ID NO: 61314 - DNA, 2336 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtga

SEQ ID NO: 61315 - DNA, 2414 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61316 - DNA, 531 bp, Homo sapiens
  misc_feature (18)..(18): n is a, c, g, or t
  misc_feature (24)..(24): n is a, c, g, or t
tgcgggtgctcagaggtnccggantggcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaatggtcgccaatccgcggattggcgaccatttcacaacataaatatctccttcatgcagggataagccttattattaaggcagccttccttcatacctacctaaaattagcaacactaaagaaataagaaacttgt

SEQ ID NO: 61317 - DNA, 483 bp, Homo sapiens
catgctcaccagtgtgctttcattcatttggtggagaaacctgggtagggaggaggcacaagtccagccacagaaaccctgtgccagtgaggctggggatgtggtgaatcttgcattggtgagtgactcagacacagaagagcttcaggtgacaagcactgggacatagcattggaggtgggaggtgggacagggagaatacaaacgttgtcattaaaatagtaaccccccatcctgccctaatgtctgtcttccctagtgcccagcatgggcagctcttcaccaatggggatcattgtggctgtggtcattgcgactgctgtagcagccattgttgctgctgtagtggccttgatctactgcaggaaaaagcggatttcaggtttgtagctcctcccagtcccttttgttatcagtttccatttggcccagggcctaaccccagacattgccagaatcccgctcttagggctagatatgcat

SEQ ID NO: 61318 - DNA, 2846 bp, Homo sapiens
gtctcttaaaacccactggacgttggcacagtgctgggatgactatggagacccaaatgtctcagaatgtatgtcccagaaacctgtggctgcttcaaccattgacagttttgctgctgctgggagtgagggtcattctgaaatggggcaatttcagacactcctactgcctggactccaggtaccagtgtggtaaggagcaggcctgggccctggaagcaggggatagattgaaagaggagagaggaccctgaattcttaagtgttccaatggttcctaaggtcagaactcagaggtagtttcatagtccctggaaagtccattctgcaccaaacattcatgtgtactttgtagtcatgaggaggaacaggaaatgagataaaggggacatatgaagtgaatacttttataaaagatcaactggaaacaggatcttgagatgggtcctggagaaggaagagcccaagctcacctccccagcatttcacatacgcagctaaatttgaagccgtgttctcctgctcgacgttgatccactctcttctcttttacagcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61319 - DNA, 1891 bp, Homo sapiens
aatagaatcgagctcgtaccagatccccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61320 - DNA, 2291 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61321 - DNA, 1783 bp, Homo sapiens
actttctctttctttttctctctcatgttactttctctttctgtcttcctttttaatgccatggagtactatattcttcaaagttccaacaaagatgcactacatttggacaatgtggaaatggccctcagccttctcttcctgatgtgccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61322 - DNA, 1947 bp, Homo sapiens
tacagacagaggtttgcaggaaagagtgggcgtggactgcttactgggaagcactgttaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61323 - DNA, 2048 bp, Homo sapiens
tggttggttaacatcaggttactcttttgtaaggatgccaattgaaactggcctgtttgggaaattagatttttaggttattaggttattatctctctctcctgatttttccaaaggccagataagaatgtagtttctgtttggtgacttgaaactttatcgtgggtgattccattttgatttttagtctgttctgtttgggcctagtgcaggagcttagtgcaaaacaacagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61324 - DNA, 1659 bp, Homo sapiens
gagcacacgaggaggaggctgccgtgagctataatcacaccactgcagtctagtctgggtgacagagtgagaccccgtggcttaaaagaacagggggggacagaaatcagattccgggccgatagacttgcagatcacggcaaatacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61325 - DNA, 1465 bp, Homo sapiens
  misc_feature (18)..(18): n is a, c, g, or t
  misc_feature (24)..(24): n is a, c, g, or t
tgcgggtgctcagaggtnccggantggcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61326 - DNA, 1521 bp, Homo sapiens
ccagcagtagggatccacagagagggcataggaaagaagatgttaaagaggctggacattggggctgatgctgggcacttggacaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61327 - DNA, 1707 bp, Homo sapiens
tggttggttaacatcaggttactcttttgtaaggatgccaattgaaactggcctgtttgggaaattagatttttaggttattaggttattatctctctctcctgatttttccaaaggccagataagaatgtagtttctgtttggtgacttgaaactttatcgtgggtgattccattttgatttttagtctgttctgtttgggcctagtgcaggagcttagtgcaaaacaacagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61328 - DNA, 786 bp, Homo sapiens
  misc_feature (17)..(17): n is a, c, g, or t
gattcggagctcggtancctgagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61329 - DNA, 2019 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaaccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61330 - DNA, 1394 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcactccagcctgggcaacaagagtgaaactccgtctc

SEQ ID NO: 61331 - DNA, 1071 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgaaaggggatctggtaccgagctcgattcta

SEQ ID NO: 61332 - DNA, 883 bp, Homo sapiens
gtctcttaaaacccactggacgttggcacagtgctgggatgactatggagacccaaatgtctcagaatgtatgtcccagaaacctgtggctgcttcaaccattgacagttttgctgctgctgggagtgagggtcattctgaaatggggcaatttcagacactcctactgcctggactccaggtaccagtgtggtaaggagcaggcctgggccctggaagcaggggatagattgaaagaggagagaggaccctgaattcttaagtgttccaatggttcctaaggtcagaactcagaggtagtttcatagtccctggaaagtccattctgcaccaaacattcatgtgtactttgtagtcatgaggaggaacaggaaatgagataaaggggacatatgaagtgaatacttttataaaagatcaactggaaacaggatcttgagatgggtcctggagaaggaagagcccaagctcacctccccagcatttcacatacgcagctaaatttgaagccgtgttctcctgctcgacgttgatccactctcttctcttttacagcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatg

SEQ ID NO: 61333 - DNA, 1369 bp, Homo sapiens
aaataaagaaaattaacgccatccgaagagacagagaagacaagaaaatcacagattccactgacctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtctgcagttaccagaaggatgtgaccttctcagagaagtcattccaggcagattagaaacatgacccacagtctccttgatggtttgtacagctgatctctcaagcagcaatctctaccagctgtcactggtgctctcggagagaggattaaccaagaaacccagcccaggaacagtactgacctctacttctggactcctgcctccctcttaaaaagtcccttgaacttcctagtgggttctaacctgtcaaaggagaaaatagccacctatggagtaagggtttttagtttctctttttacaaatggaagtttcctttgaatcaggcaagtaacgttaaatagaagccaacttttaagtttctccttataacacactgctaaattataacaccagactataccacatactctccagctgccagctattgcagttgccatccttgttactatagtggtaagtatctctgcctgtcatgcatgagagagggggtcgattccctgacagggaggttacggaaaattgtgtggggattttgtcaaccttcaaaagtctcagaaatgtctccttgttttggctttcagcggaaatccgaacaccagaagatctgaatggaatgttctggattgaagaaagtgggaaatggcctcaattcacaaagtcacagcctgatagaaaccagtgtgactttactgcccagtgaacccatctcgtcctccagcctttaggaggtaggttggactggagcctgcagtagtttactctccacctgagtcctggtctccggctgggaacccacttaggccatagagaaaaacgcacactgtgcctctccaccgggcctctggagacgaggctcctcggggatacaaacagtggggagaacatgagggacatcctgaccgtacactgcgtcctcctttcccaggtgttgcgttctctcttgggttgagtggcgaggtctctcccgagtcccagggccacagtgcaatgtcacatctcctttgtggaaagtgactggtaaaagagaacaaaactggaggaacctaaagtcttcggccacctggtttaatttattcaagagtgattaatcctagatgagaaaaagaattgaaatggatcg

SEQ ID NO: 61334 - DNA, 219 bp, Homo sapiens
tatggttttgcagcctcagcatcagcgtgggcaggcccttttcaacagcagtgccctggctaatccttttctttttccccacagccaattccactgatcctgtgaaggctgcccaatttgagatgagtaatcccagccatctccttttcttcctgccttgtcccttctctcctgtttcctctctttttgcctttgttaatgcaaaattaaaatggagac

SEQ ID NO: 61335 - DNA, 846 bp, Homo sapiens
tgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaacattctgtttaccttttcagggctgtattgattggggtgtagactgaactatccggggtctgtttcttttcggtgatgaaagtcttgagaaggtagtaatggataagatgtgaaggagaggagagatggagatttggagtgtagggtgagtgcccctcttcttaaaactgaatactcttcttctaatgaacttgtattcttgtttccatgtcttcttgcctttccttctatggcaaataaagcattcactttgttttggaacacaag

SEQ ID NO: 61336 - DNA, 912 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaaggtatggggagtctgccaagatgtagggaggggagaagaggggatggacaagggctgaggtcacatgggcctacatggaggtctgagaaagcccatagcagcaaaattgggcactggagcaaagaggagtggggtggaagcctggctaagtattgaccaacaagtaggggccagagcttggagccctcacgtcccaggtaataggtagtcaggctgttgtttcactttgaaatgtaggccccagactaaagatggcagtgaagcagagctccctcat

SEQ ID NO: 61337 - DNA, 3360 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagatgagtaatcccagccatctccttttcttcctgccttgtcccttctctcctgtttcctctctttttgcctttgttaatgcaaaattaaaatggagactgggcctgaaaactcctgagcaaacaaagccacccaggccttagaaatagccttatcattgcttaaactgcaaacataagtgaaactcaagttggattgtaactaaaaataggtaatacttaacttggatcatttctggtaaatgtttatgttagacagaaataagatttaaccctagccaatcgtaagcagccttcagataaaatgaattatgtgactaagaacacttcaataaggtacctcacccaaaagacaattatgtaactgcaaacctatcaaatttctttattttacttccacattttcccaattaatacctgtctctgactttctgtcattaaaacattagacctcttttggtttggtgtcacccaattcatgaattgcttcttactcaaatgaactctttaaaattgtattgtgccttagatttttctttaacagtttggtgtcagaagtaggatataaagtagaatctcccccaaagatccctaagagcaatgggtgaccaggcataggtacccattaagcccattgtgttcactggtttcttcctgcatttgtgagtcactaggtaagtccctctcagatatcaggcttgcaacttgtgtcctgagctctctgagtttatttgagtaattttatttctcatttgattcagcggttaatctgggtatttgacaagttcatctgtttccaacaggaactatactaggtccagtatagtgtactagtttccagacaaggtctgatttctggattgggatccagaggtcaaattgggtacttgacagattgaactaggtgttcaacagaaactgaactgggggtccagttgcagtcctgcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61338 - DNA, 2016 bp, Homo sapiens
catgctcaccagtgtgctttcattcatttggtggagaaacctgggtagggaggaggcacaagtccagccacagaaaccctgtgccagtgaggctggggatgtggtgaatcttgcattggtgagtgactcagacacagaagagcttcaggtgacaagcactgggacatagcattggaggtgggaggtgggacagggagaatacaaacgttgtcattaaaatagtaaccccccatcctgccctaatgtctgtcttccctagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 61339 - DNA, 2018 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacatgccactggatgggggcatgagggcatgccactggatgagggcatgagggcatgccactggatgagggcatgggggcatgccactggatgagggcatggggtaccga

SEQ ID NO: 61340 - DNA, 1802 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaatggtcgccaatccgcggattggcgaccatttcaaaccttcagtagaggaaggaggaagagtagcatttaaaatgtacactaggactggttaggttgcttttcctagttagcactgatcttagaaagaaggttggtaggcatattccaactgccacagcacccttcctgtttcaaatgtggcaggttattcattttgtgtgcagtttgtctcctccaatgattagacgaaagagttttctgaccatcattcaaaaggaatgtgagaagttaatgaatcctagaggaaagcggctgagaaaaggcatctggcatttggttgagagcctctctatgtggtgctagtcaaactacttttacatggagcctgaattcaggacagaaaacactgctccttctcctcgctctcagttgttgggaaagcatggttacattgaaatgtcccaatccggggatcctt

SEQ ID NO: 61341 - DNA, 2276 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcggctgtattgattggggtgtagactgaactatccggggtctgtttcttttcggtgatgaaagtcttgagaagcaaataaagcattcactttgttttggaacacaagttctcagaaaggcaaactttaggtgaatcgtcagtggagactgctgacttcctgcactgctattttcccagtgcagttaccagaaggatgtgaccttctcagagaagtcattccaggcagattagaaacatgacccacagtctccttgatggtttgtacagctgatctctcaagcagcaatctctaccagctgtcactggtgctctcggagagaggattaaccaagaaacccagcccaggaacagtactgacctctacttctggactcctgcctccctcttaaaaagtcccttgaacttcctagtgggttctaacctgtcaaaggagaaaatagccacctatggagtaagggtttttagtttctctttttacaaatggaagtttcctttgaatcaggcaagtaacgttaaatagaagccaacttttaagtttctccttataacacactgctaaattataacaccagactataccacatactctccagctgccagctattgcagttgccatccttgttactatagtggtaagtatctctgcctgtcatgcatgagagagggggtcgattccctgacagggaggttacggaaaattgtgtggggattttgtcaaccttcaaaagtctcagaaatgtctccttgttttggctttcagcggaaatccgaacaccagaagatctgaatggaatgttctggattgaagaaagtgggaaatggcctcaattcacaaagtcacagcctgatagaaaccagtgtgactttactgcccagtgaacccatctcgtcctccagcctttaggaggtaggttggactggagcctgcagtagtttactctccacctgagtcctggtctccggctgggaacccacttaggccatagagaaaaacgcacactgtgcctctccaccgggcctctggagacgaggctcctcggggatacaaacagtggggagaacatgagggacatcctgaccgtacactgcgtcctcctttcccaggtgttgcgttctctcttgggttgagtggcgaggtctctcccgagtcccagggccacagtgcaatgtcacatctcctttgtggaaagtgactggtaaaagagaacaaaactggaggaacctaaagtcttcggccacctggtttaatttattcaagagtgattaatcctagatgagaaaaagaattgaaatggatcg

SEQ ID NO: 61342 - DNA, 1119 bp, Homo sapiens
gtctcttaaaacccactggacgttggcacagtgctgggatgactatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggcccatgtatatgtgtactggctgtattcctgcgcacaccgggccacctggccg

SEQ ID NO: 61343 - DNA, 613 bp, Homo sapiens
tgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcattactttttttcttttatataataaatgaaaaaaacactgaaa

SEQ ID NO: 61344 - DNA, 232 bp, Homo sapiens
ttgatggattttttttttacattaaaatttccatccccctagagtttgatttcattgtatgaggtatggttgtcatcttattttccaaatggctagtgtgtgtctgggtaccctgtattgcttgctcatgatcttcaggtaccttttgagacttaaatattttgactccatcttgccctgacagtgtttaggtctcatcagtgattatgataatgatgatgaaggcctgtct

SEQ ID NO: 61345 - DNA, 487 bp, Homo sapiens
gctaagatcattgacgaaggtggcctcactaaacaacagattttcagtgtgcattaaacagtcttgtattggaagaagacaccatctaggacttctatagctagagaggagaagtcagtgcctggcaagctgaagccagtgctcatttaccatttggaatatcctagggcccttaagaataatgttaaatttgcgcttgccttggcagcctatatactaagaatgatgttaaatttattctggctgtgtgcagtggctcacacctgtaatcccagcactttgggagtacgaggtgggcagattagttgagctcaggagtttgagaccactctgggcaacttggcaaaagcccatctctacaaaaaatagccaggtgtggtggcttgcgcctgtagaacacacctcccaggttcaagtgattcttgtgccttagcctcccgaataactgggattacagaggtgtgccaacatgtcctgctagtttttg

SEQ ID NO: 61346 - DNA, 117 bp, Homo sapiens
aggtgagctatttttaaatttctctgatgtacctgtctagaaaaggttgctttggaataagttcagttgaattttagaactcagagaacaaaggttttcatctcaatcatctcaaga

SEQ ID NO: 61347 - DNA, 778 bp, Homo sapiens
taataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactgtggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagtttaaaaaaaaaaaa

SEQ ID NO: 61348 - DNA, 626 bp, Homo sapiens
tggaatctacggataacatcaggttctaagtcgtaagtagatttttaactactaggtttaggccaggcaggcccagggctggtttcaggcctggtgccgggctgcctgtctttgatttcacttccttgtttttttcttaaaacaggtactgagtataaaacaatataatacaatatgagaaggtctctctcttccctcaagagtgtatgactttgctgcccaggatgatcttgaaccccgggcctcaagctattaatttcttccccacttcagcctcccaaagtgctgggattacaagcctgagccactaagccgagccaagcctagtcttttttttctgaatagcactaatacctcaaaaaagacccctaaattctcagaaaagtaactattttattctcaaacatctgttgtatttttgaatagcagtagaaattctacttcaacgataaaattctttgtgttaaggcccaatttataaagcttaattttggcagtatttaaaaacaaaattcccgtagatcattattgacaggtgcattccttggagtgtgaaacctctgaaaaaaatagaaaatgtccagcttggctttatatcttggagattgcatttgttgctgctaaat

SEQ ID NO: 61349 - DNA, 486 bp, Homo sapiens
ggtcaaaatagattttggaaaacttgaaaccttttggaacctgggtagcttgaaaaaacaaaacgacagggtctccctatgttgcccaggctgatctcgaactcctgggctcaagttacactccccacttcagcctcccaaagtgctgggattacaagcctgagccactaagccgagccaagcctagtcttttttttctgaatagcactaatacctcaaaaaagacccctaaattctcagaaaagtaactattttattctcaaacatctgttgtatttttgaatagcagtagaaattctacttcaacgataaaattctttgtgttaaggcccaatttataaagcttaattttggcagtatttaaaaacaaaattcccgtagatcattattgacaggtgcattccttggagtgtgaaacctctgaaaaaaatagaaaatgtccagcttggctttatatcttggagattgcatttgttgctgctaaat

SEQ ID NO: 61350 - DNA, 601 bp, Homo sapiens
tttccctgatgactaatgatattgagcaccttctcatgtgcttattagccatttacttatttttgtgaattttatgttcaagtcttttgtccattctttaataatttttaatatttcatgatgaaaattccaaatatgcacaaccgaagagagtacgacagagccttacgtgactcttaccttgactctgtactgtagtttttcatcattccttcgtcacttgcaaattcaagtatttttcccagccattaattgagtttttgaagatgaggaattttttattttggtgaagtccagcttatgaactttttctcttacatgtagcactttctctgtccagaccgatgttatatcctgagaacctcttcacctaggaaacctaccacatatcagactcagcgtgtccataacttatcttacctcaaatccattcttcttccagtaatattacataaaggctacttgggagtgtagattctgggaaacctgaatctatgttcccgggctgcagtcttcaagcttggcccagatgaactctctatttatactaaaaatatgtaaataaataaaaataaaaagaaataaatgctactatatcggt

SEQ ID NO: 61351 - DNA, 465 bp, Homo sapiens
tgagttatactccccaaatctcaacacaatgaaatgttaggtagaagctgaaataatacaaaagtatttggcagtgtaatcattcctactgagtagatttagatcccttcagaatcatagaaccataattgaatccgtggatcgttttgaacctaagattctgtctgcatgaaacatttctttcgcattttgtcatataatgcacaagcagtttgtggaactaaggctaagtgactaataaatatatggaaaattaaataatgcaaatccatatggaaatgcctatcctccctctttgtttctgtactctgaaaatagagagtttgtctatccagacagaaattttagactgacgaaaattggaaatgactgtggttctcaaacttgaccacgtggccaccaaccagaagttacccggagggatcctataggtgctctggaatcttctctcctgtaacctaaaat

SEQ ID NO: 61352 - DNA, 411 bp, Homo sapiens
ctctttctttatttccctaatacctttccaaaggtgtcacccactatgagccaatgtggataatgctaacaatgataaaaaatggtaaccaccaaaagtattaaattaatagaggctatcactgtttgaaagttttttgtcattgccaggtaacatgccaagtgtcttactcattttaatcctcataataatactttgatgttatcattattatcctgatacggtttatatgtttgttccctccaaatctcatgttaaaatataatctccagtgttggggtgttgggaggtggggcctagtgggaagtgtttgggtcatgggtgtggatccctcatgaatagatgaatgcccttcctcgtgggtagataagtgaggtctagctctttcaggtcccacaagagcttggttgt

SEQ ID NO: 61353 - DNA, 520 bp, Homo sapiens
ccccccttaaattttaaaaaaggcaacaataccaaaatccctttcataagtgcgaatcccccaccctattgatatttattaaaaaaaaactaaagggtttaagaaaattttttaaagcctttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgaaaaaaataa

SEQ ID NO: 61354 - DNA, 1746 bp, Homo sapiens
acacatacaggtgagaagaaatttgtttgttcagaatgttcaaaatgctttgtgagaagtgaccatcttgccgaacatactaaaacacagcagaataaaaaaggtattcactctagcagtacggtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaacaaaagtttaaaatgtataagttgaggcatttgggtggtaagagaatgttatagtgaattatcccttttcttgactattggaggaccaaaacaataaggtgtattgcgtcttagcagtgatttttatccaatcttgtttccaaaaaccatagtctgccaggccttaaagccatcatgtaaattaccagtatatgtaacatatgcaaacattaccaaatcacttccatagtgacgatactccaaccatatggatattagtcatagaagaactagaggttttatgatatttttttaagtcctttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgaaaaaaataa

SEQ ID NO: 61355 - DNA, 1036 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaacggaa

SEQ ID NO: 61356 - DNA, 456 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcagccgcaggacctcatccagtggggggccgagtacgtgctcctttctcgccttcatctcttggaggacgggcggggagagagggtcctgtaaaaccgcggaggttgtcatggctgca

SEQ ID NO: 61357 - DNA, 377 bp, Homo sapiens
cgggcaaggatgggatgcctcccctaagcgagccagattgagcagtaggacgccaggtcaataggccgtgtcctggggcaagcagcaagttagatgaccgcgtcacaccagcgtatgcacacccacctcctccctgcacgccttttcccactctcggtggaaagaagggctgggaatctccgcagcttaatctgcctttcttcattctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaggctttgtatctttgagga

SEQ ID NO: 61358 - DNA, 1082 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaacggaa

SEQ ID NO: 61359 - DNA, 1284 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagggcaaggggaaggcaaggggatcttcaagagaatgtgactgtgggggattatggctttctggccaatttgttacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaacggaa

SEQ ID NO: 61360 - DNA, 842 bp, Homo sapiens
atatacttttgagtaaataagctgttttgcataatcttatttttttgttttacaaacatatatatttatactgaaaaattctggaaggagacatccaatattttagggtgataccattagggatttttttgttgacttccactttttaaataaaaaaggactgtgtaatttttacgtaaaggatataactatttacaacaaaaagtaggggttagcagacggctttctaaccttgccgttgtgtaacaatagaatgcatttgtcttgcggagtccccaaaattgagtgtcaaacagaggctgggtgacctcctgtccaggattgctctcatcttatgagtccaagttttcatcttatgtattttttctcctgagaatagtcaaccaatcaatggctcagacagataagccaacatgcatcccgccggagctgccgaaaatgctgaaggagtttgccaaagccgccattcgggcgcagccgcaggacctcatccagtggggggccgagtacgtgctcctttctcgccttcatctcttggaggacgggcggggagagagggtcctgtaaaaccgcggaggttgtcatggctgcagccagggggtcgggactaactggcatcgtctttgttttagctcttgcattgctttgatgctttaaaatccacacataaatactacatctagccgggcaaggatgggatgcctcccctaagcgagccagattgagcagtaggacgccaggtcaataggccgtgtcctggggcaagcagcaagttagatgaccgcgtcacaccagcgtatgcacacccacctcctccctgcacgccttttcccactctcggt

SEQ ID NO: 61361 - DNA, 1158 bp, Homo sapiens
agcggggcattctggcgcggagcggagcgcgcggcggtcgcagctagcgggtcggccgcggaccggacgtgcagctcggattggtgggaggcactcggtctctccccacacctctcgcctgaggccaggcgccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcagcatgctcttcactaggatttgcaaaggtaactgccacacagagccatctttaccttcctaacaccccctcccgccccttgccatgtgctgggagatgtggacctggcctggggacagggtgtttctcagggccttgtctcaacttctcccacaacctctgtgttgtgtctgtcccctgccctgcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaacggaa

SEQ ID NO: 61362 - DNA, 1195 bp, Homo sapiens
ctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagttccaggcactgggctaggcactgggatggtgtggtgagcaaaaactgaccagtcctgccgtggagtttgctgggggagacacatgttactcaaagaatcacactaaggatagcaatttatctcaaagcttcaagttcctgccatctacatgtgcccaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaacggaa

SEQ ID NO: 61363 - DNA, 452 bp, Homo sapiens
cttaaaatatgtgaaagacataaatattagaaatgaggatttaaagttggttttctaatagcttctgaaagaaagtggtatgttgattaatgaaattctaacatggtaataatcacatagacgcataacctttaaaaaaatgtacacaaattggatcataccatagatattgtcctgctccttatgtttttcacttaatcgtgcatcttgatgttcttttatgtcagcacctgatgcagagatcgttggtacatttcatggctgtattgtgttcattgtaatttatttaccgattttcatgtcagaggacatttcttggcacttctcctttctgctaccgtgtgaagaaggacatgtttgcttcttcttccaccgtgattgtaagtctcctgaggcttccccagccctgtggaactgcaagtcaataaaaactctttcctttacaaattacc

SEQ ID NO: 61364 - DNA, 266 bp, Homo sapiens
ggacacagagagagggcaagagtggaaaatagaatgaggctcagaataccaagccttagtgccatccctatcatctgtctcactccatcactgggtgatcttgagcaagtttctttctttccgtcagcttatttcctcatctttaaggaaaatccatagtgcaagacattaaatttttttaaaaggctgaaatctcccatcagtgttagaagataataaggaagaaataaactgaaacttgcatgctctagaacttgtaaagggga

SEQ ID NO: 61365 - DNA, 998 bp, Homo sapiens
aggtgggggactaggagaggcaggtgctactagctccgcactactagttttgtgaccttgggcaagctagttaatctctgcaatggacctcatcatgaccgttgctgtacttacaatgaaaacaacttggtggatggccaccaagccatgcattattcaagcccatcttgagtgctggaccatcaataatggagagacatgatccttgctctcatggaacttatgctgtagtggaagacaacatgtaaacagctgcaatacagttaaatatttgctgtaatgaagttatatatgtagtgtaaaaagggacaggaaaaatctttaattcaaggaaatctttatgaggacgtagaacttgaacagaaatgtgaagccatctttttctcaggacatttgggaaagggaattcaaggcagccactttcatctctttaagttcataatttgctacttaacttcagatccagggaccaaaggcctgaattccagttgtgcctcaagatggtgctttccctcatttttgtagctcaagacgtacattcaactcaagagtccagctctacagcagctatatttggaaatacacatattttatgaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggtaaggatcagaactgttctgcctccttgctgtatttcagagaaacccttgctgtctgtctgtctatctataatttaatatcttaaaaatgaatggtagaaatggaataaatataagattttagatttaatatatataatacatatgttttgacactgtgg

SEQ ID NO: 61366 - DNA, 917 bp, Homo sapiens
acctctaatttgttagcatttgaagtctattgatggatttttatcatgtggaaccatatatgcattcatggaataagtacaacttggtagacttattttaatatattgcttgatttggtttgcaaatgtccatttcctggcgttctagttaattgaaatacttgctttccccaaagcagcaacaccagtactttttctttcaataataacattggtgttcatattctaaaatatctagcttttcctgtgccagacttaaaggttagttatattttaatactacatgttttatgcagctccttaaacctcaaatcagaacaacactagtgatagttgtctccatatgttctcattagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaagatgagaagaggacagctgacatgtgctgctcggggatgtgggaagagactgcagattttggccttgggattctggattacttaaaacaaaagtaagacacaaatatctccctaaccttattatatctcgtagaagatggcagatgggtgacgactggtgcaagctcacacaggaaagaaaaatttcataagcattgaatagttgtgttactaattagtgggacaatcttcgtaactccttcttcccccacttctgcccaatatgtaataataggcatgctctgaataattgtactcaaataagaaattactcctccaaa

SEQ ID NO: 61367 - DNA, 3637 bp, Homo sapiens
tacagacaaagaacctgagacctgctagagtaagtgacttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccagccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggcgctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagaaatt

SEQ ID NO: 61368 - DNA, 3395 bp, Homo sapiens
tacagacaaagaacctgagacctgctagagtaagtgacttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccagccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggcgctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagaaatt

SEQ ID NO: 61369 - DNA, 2685 bp, Homo sapiens
tacagacaaagaacctgagacctgctagagtaagtgacttggttaagatagggagcgctccagagaccaggtccaagatcttcccccgtttcacaattagaaggcggctgtctagaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagaaatt

SEQ ID NO: 61370 - DNA, 2991 bp, Homo sapiens
acctctaatttgttagcatttgaagtctattgatggatttttatcatgtggaaccatatatgcattcatggaataagtacaacttggtagacttattttaatatattgcttgatttggtttgcaaatgtccatttcctggcgttctagttaattgaaatacttgctttccccaaagcagcaacaccagtactttttctttcaataataacattggtgttcatattctaaaatatctagcttttcctgtgccagacttaaaggttagttatattttaatactacatgttttatgcagctccttaaacctcaaatcagaacaacactagtgatagttgtctccatatgttctcattagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagaaatt

SEQ ID NO: 61371 - DNA, 1874 bp, Homo sapiens
tacagacaaagaacctgagacctgctagagtaagtgacttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccagccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggcgctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagaaatt

SEQ ID NO: 61372 - DNA, 1904 bp, Homo sapiens
tacagacaaagaacctgagacctgctagagtaagtgacttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccagccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggcgctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctc

SEQ ID NO: 61373 - DNA, 3256 bp, Homo sapiens
aggtgggggactaggagaggcaggtgctactagctccgcactactagttttgtgaccttgggcaagctagttaatctctgcaatggacctcatcatgaccgttgctgtacttacaatgaaaacaacttggtggatggccaccaagccatgcattattcaagcccatcttgagtgctggaccatcaataatggagagacatgatccttgctctcatggaacttatgctgtagtggaagacaacatgtaaacagctgcaatacagttaaatatttgctgtaatgaagttatatatgtagtgtaaaaagggacaggaaaaatctttaattcaaggaaatctttatgaggacgtagaacttgaacagaaatgtgaagccatctttttctcaggacatttgggaaagggaattcaaggcagccactttcatctctttaagttcataatttgctacttaacttcagatccagggaccaaaggcctgaattccagttgtgcctcaagatggtgctttccctcatttttgtagctcaagacgtacattcaactcaagagtccagctctacagcagctatatttggaaatacacatattttatggccagtatataaatgatttttaataaaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagaaatt

SEQ ID NO: 61374 - DNA, 3218 bp, Homo sapiens
aggtgggggactaggagaggcaggtgctactagctccgcactactagttttgtgaccttgggcaagctagttaatctctgcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagatccagggaccaaaggcctgaattccagttgtgcctcaagatggtgctttccctcatttttgtagctcaagacgtacattcaactcaagagtccagctctacagcagctatatttggaaatacacatattttatggccagtatataaatgatttttaataaaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggctggcagtcggacccagaacattgctccagacagcaactttaccagctatgaagcttctccctgcattcttacacagacgcttcaggcaggttcttcagacccatgcaatttcaaccccttatgttcatgatcatctggagttaggcagagcctacaaattgcaagggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaagaaatt

SEQ ID NO: 61375 - DNA, 1405 bp, Homo sapiens
tacagacaaagaacctgagacctgctagagtaagtgacttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccagccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggcgctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggtaaggatcagaactgttctgcctccttgctgtatttcagagaaacccttgctgtctgtctgtctatctataatttaatatcttaaaaatgaatggtagaaatggaataaatataagattttagatttaatatatataatacatatgttttgacactgtgg

SEQ ID NO: 61376 - DNA, 350 bp, Homo sapiens
tattttaacagccttttaaaataattgggatattcttctttgatactataccagaatttgataaatagtagtgttttaaaacatagttgtaatgcagaatctcaaactgtatccatgaatttttttaattctattatattaaaatgtggtgttctgtactttggacagattttataataggaatgtatagcatgactttataacatgatacgttagctttttggaaagtattgattcattgaattattcagagctccaagtattgacacatttcattacacagtatcaaaaaattatatttgttagtatcgattgtatagtatcaccaatctcatcagaaaagtatttaa

SEQ ID NO: 61377 - DNA, 393 bp, Homo sapiens
gtagcgacgcggacctggctgagaggcgttaggagtccgggcgttcggccggaggccggggagcagccgaccatggagccccagagagcttggtcaatgtgttctggacaaagcaggaagatgtgactgaaatcctgaaaggagccggctcctgcagcacaaggataatgatacatctgggtacatttctcttcacagcatttgatagtggctccaaagtgcttacaaaatgcacatcgctgaaaggggtaaaggagagaaatctctttataaaaccttgaaaaggaatattcaaatataagctgggaaggtataaaaaactctctgtacatcacaagtaaacaaattgaacctgcaaaatattaaacaaaggattcattaaaaataataaaa

SEQ ID NO: 61378 - DNA, 3112 bp, Homo sapiens
aggcggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaatatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 61379 - DNA, 2576 bp, Homo sapiens
aggcggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaataagtcagaggtcccagaagagtcagctcaaaaaaatacgtttgtcagttattgaaggaaacaaaaggcaacttcagtattcatcgtgatcacgatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 61380 - DNA, 509 bp, Homo sapiens
aatctcgtcagatggtgacggacctggagctgagcacactgctgcccatcagccatgagaatctcactgcagtgccacaaataagtcagaggtcccagaagagtcagctcaaaaaaatacctttgtcagttattgaaggaaacaaaaggcaacttcagtattcatcgtgatcacgaatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 61381 - DNA, 3205 bp, Homo sapiens
aggcggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaataagtcagaggtcccagaagagtcagctcaaaaaaatacgtttgtcagttattgaaggaaacaaaaggcaacttcagtattcatcgtgatcacgatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 61382 - DNA, 3168 bp, Homo sapiens
aggcggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgaacacactgctgcccatcagccatgagaatctcactggcagtgccacaaataagtcagaggtcccagaagagtcagctcaaaaaaatacgtttgtcagttattgaaggaaacaaaaggcaacttcagtattcatcgtgatcacgatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaacccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcgggaatggggatgtatttttttaagcattgcagatatcaaagttctattgtgctgaataaatgcccctttgttaaca

SEQ ID NO: 61383 - DNA, 762 bp, Homo sapiens
ggacctgggggagctttccccaatgcccatgatgatatcttgggaacctttttgcttcctccccagatggttgggtcacctccagggtgtgggggctaagagcatggcaaggctcagcagagctcagcaggcagaggtggatggacattctggggtgaggtccctggggccagacagtcccagcagggtgggacaggacagggcaggcctggaagaccttcaatcacacaaatgggcaggactctacctccagaagggagtggactcccctgggctcggtgattctccctcctcagtctccctcttgagtagctgggactacaggcacccgccactacgcccggctaattttttatatttttaatagggacgggggtctcaccatgttgcccaggctagtcttgaactcctggcctcaagtgatcctcccaacttggcctcccaaagtgctgggattaaagacgtgagccaccaaacccagccccattctaataattagtggactccagcaggcaggcggcccgaaattccagcaggagacacacaagccaggagagaaaagagacctgaagtctgggaacaggaagtacctgctccctgcataggacagcctgatcctgggagcaagagtgccaggcaaggggtagggaggagaacaggagagatgggaagcacatgtcttgccgtcccctcagaggcttccttgcagggaactgaatgacactctagtgcaggctggatgagcttgtcatgctccccacc

SEQ ID NO: 61384 - DNA, 194 bp, Homo sapiens
agggatgtatgaatgctggagggagagacctggctgcagggagtggactatgtaatattgtcaagcgcctacactagctaatgcagtgtgccaggtcattctaagtgctttacatatattaatttttctaaatctcccaacaaccctagaagtaagtactacaggtccacagtcccttatctgcctttccagga

SEQ ID NO: 61385 - DNA, 282 bp, Homo sapiens
tcgaggatctcacattgcacatagttgtcctgtatctacagtctctgctaatcaaggacagctcctcagtcttcagcacctgggcttttacaaagagcactggtcagttattttgtagaacatccctcagtttggttggtgttttctcatgattagattaagcttattcaccttaggcaagaatacctcagaactgatgctgtgctcttctcaatacatcctacatcagagggtacatgatgttgatttgtcttcattttggtcatattaactttgatactt

SEQ ID NO: 61386 - DNA, 1126 bp, Homo sapiens
tgtaacgtggagcctggtcgccccagcccgggagagggggaccctgcccgcaccctcctggtctggggagggcctagtggcagcccaggtgcagtgggccggaggccaggggagcccgtgtaggggaaccgcctggcctctgttcagtgtgcccctcccctgggtggggcttcaggcgctgagtcatggctttggttggggggcagcctcaccctcctccccgtcctccaagctgctgaggaaatcctgggctgagcacagcagaggaggcctaggtccccaggactgaggaagggagagctgaggggctcccagcagtgggagcggctctcggggcctctgccagggcccaccctgtccccatgagcacgtccgtgagctcctgggtgcagccatccccccttgctggctctccagggacacgggcgccccaaacccgagggcggcagctctgggtgcagctgtctctgcatccggccctgctcaggggtggctgcaactcctggggtgtggcgctctctgctgccttctcctgggaggatggtcccttctctgttctgggatcctccagctgaggtagaggtcagggtccaggggctgcaggctgggcactggcggtcagcggacaccacagcgagattccctccatcgccccctgcttcgggattcagagtcctcttagccccttgggaacaagagagggctgctcagagaggacctagtgtccttctggggtggctgggacccttcaaggtccctggctggggcagcctggtgcctgcagctccagctcctaattgaggacacgccccatgtaaaccacaggcccctcccccgaggcctgggacaccggtcagggtagcaaggtacgagggactgtaggccctgatggcctctgctcctggacccctgccctagacctggagtcctggccccagcccgggccctgtggtgcccaatccccaggaggccagatggcccggacagccagtgagccgattgtgtggagggctgccgggatcctggccctgtttccctgtgtgagcttggccccgcctcttgccccaggcccctgctggcgggtctcaccccccacccctcgctttgaataaagcacttgcgccca

SEQ ID NO: 61387 - DNA, 2394 bp, Homo sapiens
taggctaggtacgaggctgggtgttgaatcggccgaggctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61388 - DNA, 502 bp, Homo sapiens
acgagcggtccgggccggcgcggctgccgctcggcgccgcggtcctcgtgccagtgagcgccgcggccgccgcagccatgaccgtggagttcgaggagtgcgtcaaggactccccgcgcttcagctggtgaagctgtgcagtggcatggtggaagccggtaaggcctacgtcagcaccagcaggcttttcgtgagcggcgtccgcgacctgtcccagcagtgccagggcgacaccgtcatctcggtgaggggccgactgacctctgacctcaaggaatgtctgcagaggttcgctgacagcctacaggaggtggtgaactaccacatgatcctgtttgaccaggcccagaggtccgtgcggcagcagctccagagctttgtcaaagagcctggtggcgcatgcctgtaatcccagctgctagggaagctgaggcaggagaatcacttgaactcgcgaggcagagattgcggtgagccgagacagcaccattgcactccagcc

SEQ ID NO: 61389 - DNA, 3656 bp, Homo sapiens
acgagcggtccgggccggcgcggctgccgctcggcgccgcggtcctcgtgccagtgagcgccgcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61390 - DNA, 3741 bp, Homo sapiens
acgagcggtccgggccggcgcggctgccgctcggcgccgcggtcctcgtgccagtgagcgccgcggccgccgcagccatgaccgtggagttcgaggagtgcgtcaaggactccccgcgcttcagacgtgtgcacaagtgtgcatcggctttgcttggtggacatttggcaaacgacaatggaggcaaagaaacctctctgcatccccaaggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61391 - DNA, 3631 bp, Homo sapiens
acgagcggtccgggccggcgcggctgccgctcggcgccgcggtcctcgtgccagtgagcgccgcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctggagttgggcaggcctctggagttgga

SEQ ID NO: 61392 - DNA, 3866 bp, Homo sapiens
cggtggtcacctctgtggcctcagtcactggctccttgcggggcctttgcttgcctgtgggacagcagccccgggcaccatcccgggcagaggttggctgcaggcaggagtggctattttgggataggggagagccccccaggagttggggacgggtccaccagtcaccaggagttggggacgggtccaccagtcaccaggagttggcagccgtcactcactggctttctccccctaccccctcctgctccggccctccagacgctgctgcaggtaagtgagcacgggccctgggcgggctgtgggtcgggggagaccagatggggcggtgcctttccctcctctaccccaagggcacttcagcaccaaggacacctcccaccagtctcggctcctgctgctgatgcggctgtgaggggctggctccggccagacctccacattccccgtggggttggcggcagctgtcccttcccatcccatgtggcctggggagcaggtggccgcccctcccctctgcttccctggcctgccagatggcgggacacacagggccctcagtgactcccaggcctcctgaatggggctctgtccgcccagctggccacatgaatggggcactcaggatgcggagggtgggggcgcagcttccttcctgatcgcagcctgctggtccctgcagggctggggtggggccggcactctcgggcccccagctgtgaacgtgaggggtctgccccacgggttgcagggctgggggccttgctcaggtcaagaagtggctgtggtgaacagagggtctctcgtctgagcgtgtggtccgtgggccgtgtggcagcctcagacaaggacctcacccccacctgtgctccgggaaagcacggagggtagcagggcccctggggtgggcactgagggggcgggttccatccccccaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61393 - DNA, 3201 bp, Homo sapiens
cggtggtcacctctgtggcctcagtcactggctccttgcggggcctttgcttgcctgtgggacagcagccccgggcaccatcccgggcagaggttggctgcaggcaggagtggctattttgggataggggagagccccccaggagttggggacgggtccaccagtcaccaggagttggggacgggtccaccagtcaccaggagttggcagccgtcactcactggctttctccccctaccccctcctgctccggccctccagacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61394 - DNA, 2891 bp, Homo sapiens
agcagagagctggacacggggcttggggctcaggcagtcggcctccgggtctccaaggtgaagcaggaagtgggtggtcggggccgggtggtggctgagggcaggggccacagcggtgccgcccacaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61395 - DNA, 2180 bp, Homo sapiens
acgagcggtccgggccggcgcggctgccgctcggcgccgcggtcctcgtgccagtgagcgccgcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggctgacgaagagggtgcaacagtccgacagagagcaaaggcgaagaacacggggacacgcaggcccaggccggggcctgggcaaaccccacatgaccccagcctcggccacacgcagcggccgaaccgcgtgaggggacgcaccgacagcctggagccagatacatgaacataaccagggttctctcagata

SEQ ID NO: 61396 - DNA, 1096 bp, Homo sapiens
gcggccgccccgggtggagggcgtgcgcgtgggcagccgtgggcacctcgggaccgtccgcccccgctctgtgtctgcacctccactgggctgagcccctcccgggccctgcagtccagctctggccagggtcgtctgggtccgtgggggcgtcggcccctggtctctgacttgatcctgtgtccagagcagcgcgtggggaacaggcagctggagccgcgtttaaggcctggggtagggtgcctggaaacgtgaagtggtttgaatgacccaggggcttggaggggtggcggccgagaagagcggcggggaaggtcaggtagggggtaggggttgtgtgcacaccgagtctgcatgttttccatcattcgtggcgtgcaggcgtgtacacctgcgtgaactacatgttcacagacgtgtgcacaagtgtgcatcggctttgcttggtggacatttggcaaacgacaatggaggcaaagaaacctctctgcatccccaaggcgaccattgacgaggtggagacggacgtggtggagattgaggccaaactggacaaggtgaagggcgggcctggagcgccctgtgcccggccaagcttgggatggccacatggccagactcgccctccaggccttactaagccacttacaccccccatatgtggagcatgcgtgtggtgctccaggtcctggtccctgtgtcttagcatgtgtgttccagggtgcacatgtcacatgcacacatgtggctggccctgagtctcgtcccatctgggaggggctgggctgtggtgagtccccgacccacggtggctgcccgtcccctctgctgggctggtgacacggggacagctgctgtgtgggctgagccttggtgtggctggggctggggctgagaaaggggagggggcaacaggccgtggagaggggagccgtgtccatgagccccacatgggctgagaaagaggagggggcaacaggccgtggagctgggagtgggcagccttatccatgagccccacatgggctggttctgctggtcctgctggccctgggtcccctgcctggctcctggtccctcccagccgagccgtggc

SEQ ID NO: 61397 - DNA, 2383 bp, Homo sapiens
  misc_feature (1357)..(1357): n is a, c, g, or t
tgtaacgtggagcctggtcgccccagcccgggagagggggaccctgcccgcaccctcctggtctggggagggcctagtggcagcccaggtgcagtgggccggaggccaggggagcccgtgtaggggaaccgcctggcctctgttcagtgtgcccctcccctgggtggggcttcaggcgctgagtcatggctttggttggggggcagcctcaccctcctccccgtcctccaagctgctgaggaaatcctgggctgagcacagcagaggaggcctaggtccccaggactgaggaagggagagctgaggggctcccagcagtgggagcggctctcggggcctctgccagggcccaccctgtccccatgagcacgtccgtgagctcctgggtgcagccatccccccttgctggctctccagggacacgggcgccccaaacccgagggcggcagctctgggtgcagctgtctctgcatccggccctgctcaggggtggctgcaactcctggggtgtggcgctctctgctgccttctcctgggaggatggtcccttctctgttctgggatcctccagctgaggtagaggtcagggtccaggggctgcaggctgggcactggcggtcagcggacaccacagcgagattccctccatcgccccctgcttcgggattcagagtcctcttagccccttgggaacaagagagggctgctcagagaggacctagtgtccttctggggtggctgggacccttcaaggtccctggctggggcagcctggtgcctgcagctccagctcctaattgaggacacgccccatgtaaaccacaggcccctcccccgaggcctgggacaccggtcagggtagcaaggtacgagggactgtaggccctgatggcctctgctcctggacccctgccctagacctggagtcctggccccagcccgggccctgtggtgcccaatccccaggaggccagatggcccggacagccagtgagccgattgtgtggagggctgccgggatcctggccctgtttccctgttgcctgctcccggagggggtggtcacgtgcccgatccatctgcctcctgtcttccggggattctcccgccgaggcttctctggtgatgtcatgccttaactcttctctccccaggcagccccactgtcaggctgtcctggtgggagtgggctctgaggaggatggcctacccgtctttccagcggaccatgccgcttgcagctgtgaggttgggggagccgggggcgtctctccccagctggtctgggtcctcctggtgctgccaggaccgagagcagctgccctactgcccccaccctgtcccacagtgcatgggngccagacctggatgggctgcagtagtgcagtggggtgaggggaggtgccgcagggttgaggggctccagatgggtccagggttgactctgaactcctagaggagaggcgggtgaggctggctcagcccttggtgggcactgtccctgagggactcccagcggccggctgtcctgggagaggctggtccagccttcttccccgagggcacagcagcggctgcctctgcctgcctggggttgggggggcggggggaagtgcactgaacctggtcccagtcctgcccccgtagcaggcaggcgtctgtctcccagcctgtttcctgaaagccccttcccatggtggagcccctcagggaggtgcggggggaggtgaagccccgagggggctgaggctgcaggtgaccccagccagccccgttcttgctttagggcgaccattgacgaggtggagacggacgtggtggagattgaggccaaactggacaaggtgaagggcgggcctggagcgccctgtgcccggccaagcttgggatggccacatggccagactcgccctccaggccttactaagccacttacaccccccatatgtggagcatgcgtgtggtgctccaggtcctggtccctgtgtcttagcatgtgtgttccagggtgcacatgtcacatgcacacatgtggctggccctgagtctcgtcccatctgggaggggctgggctgtggtgagtccccgacccacggtggctgcccgtcccctctgctgggctggtgacacggggacagctgctgtgtgggctgagccttggtgtggctggggctggggctgagaaaggggagggggcaacaggccgtggagaggggagccgtgtccatgagccccacatgggctgagaaagaggagggggcaacaggccgtggagctgggagtgggcagccttatccatgagccccacatgggctggttctgctggtcctgctggccctgggtcccctgcctggctcctggtccctcccagccgagccgtggc

SEQ ID NO: 61398 - DNA, 5318 bp, Homo sapiens
  misc_feature (1357)..(1357): n is a, c, g, or t
tgtaacgtggagcctggtcgccccagcccgggagagggggaccctgcccgcaccctcctggtctggggagggcctagtggcagcccaggtgcagtgggccggaggccaggggagcccgtgtaggggaaccgcctggcctctgttcagtgtgcccctcccctgggtggggcttcaggcgctgagtcatggctttggttggggggcagcctcaccctcctccccgtcctccaagctgctgaggaaatcctgggctgagcacagcagaggaggcctaggtccccaggactgaggaagggagagctgaggggctcccagcagtgggagcggctctcggggcctctgccagggcccaccctgtccccatgagcacgtccgtgagctcctgggtgcagccatccccccttgctggctctccagggacacgggcgccccaaacccgagggcggcagctctgggtgcagctgtctctgcatccggccctgctcaggggtggctgcaactcctggggtgtggcgctctctgctgccttctcctgggaggatggtcccttctctgttctgggatcctccagctgaggtagaggtcagggtccaggggctgcaggctgggcactggcggtcagcggacaccacagcgagattccctccatcgccccctgcttcgggattcagagtcctcttagccccttgggaacaagagagggctgctcagagaggacctagtgtccttctggggtggctgggacccttcaaggtccctggctggggcagcctggtgcctgcagctccagctcctaattgaggacacgccccatgtaaaccacaggcccctcccccgaggcctgggacaccggtcagggtagcaaggtacgagggactgtaggccctgatggcctctgctcctggacccctgccctagacctggagtcctggccccagcccgggccctgtggtgcccaatccccaggaggccagatggcccggacagccagtgagccgattgtgtggagggctgccgggatcctggccctgtttccctgttgcctgctcccggagggggtggtcacgtgcccgatccatctgcctcctgtcttccggggattctcccgccgaggcttctctggtgatgtcatgccttaactcttctctccccaggcagccccactgtcaggctgtcctggtgggagtgggctctgaggaggatggcctacccgtctttccagcggaccatgccgcttgcagctgtgaggttgggggagccgggggcgtctctccccagctggtctgggtcctcctggtgctgccaggaccgagagcagctgccctactgcccccaccctgtcccacagtgcatgggngccagacctggatgggctgcagtagtgcagtggggtgaggggaggtgccgcagggttgaggggctccagatgggtccagggttgactctgaactcctagaggagaggcgggtgaggctggctcagcccttggtgggcactgtccctgagggactcccagcggccggctgtcctgggagaggctggtccagccttcttccccgagggcacagcagcggctgcctctgcctgcctggggttgggggggcggggggaagtgcactgaacctggtcccagtcctgcccccgtagcaggcaggcgtctgtctcccagcctgtttcctgaaagccccttcccatggtggagcccctcagggaggtgcggggggaggtgaagccccgagggggctgaggctgcaggtgaccccagccagccccgttcttgctttagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61399 - DNA, 547 bp, Homo sapiens
acgagcggtccgggccggcgcggctgccgctcggcgccgcggtcctcgtgccagtgagcgccgcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagagtgagtggcccccagggctgggggaagaacactgaggccacgctccctcccttggaggggaagggggtctggggcagagcagaggcaccttgggcccaggcctccaggctgtgcagcggctccacaaggcag

SEQ ID NO: 61400 - DNA, 4031 bp, Homo sapiens
gcggccgccccgggtggagggcgtgcgcgtgggcagccgtgggcacctcgggaccgtccgcccccgctctgtgtctgcacctccactgggctgagcccctcccgggccctgcagtccagctctggccagggtcgtctgggtccgtgggggcgtcggcccctggtctctgacttgatcctgtgtccagagcagcgcgtggggaacaggcagctggagccgcgtttaaggcctggggtagggtgcctggaaacgtgaagtggtttgaatgacccaggggcttggaggggtggcggccgagaagagcggcggggaaggtcaggtagggggtaggggttgtgtgcacaccgagtctgcatgttttccatcattcgtggcgtgcaggcgtgtacacctgcgtgaactacatgttcacagacgtgtgcacaagtgtgcatcggctttgcttggtggacatttggcaaacgacaatggaggcaaagaaacctctctgcatccccaaggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcaagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61401 - DNA, 3217 bp, Homo sapiens
caggtggtccgccccggaggtacgggatcttccgcacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcggacgctgctgcaggacttctcctacgatgagtccaaagtggagtttgacgtggacgcgcccagtggggtggtgatggagggctacctcttcaagagggccagcaacgctttcaagacatggaaccggcgctggttctccattcagaacagccagctggtctaccagaagaagctcaaggatgccctcaccgtggtggtggatgacctccgcctgtgctctgtgaagccgtgtgaggacatcgagcggaggttctgcttcgaggtgctgtcacccaccaagagctgcatgctgcaggctgactccgagaagctgcggcaagcctgggtccaggctgtgcaggccagcatcgcctccgcctaccgcgagagccctgacagttgctatagcgagaggctggaccgcacagcatccccgtccacgagcagcatcgactccgccaccgacactcgggagcgtggcgtgaagggcgagagtgtgctgcagcgtgtgcagagtgtggccggcaacagccagtgcggcgactgcggccagccggacccccgctgggccagcatcaacctgggcgtgctgctctgcattgagtgctccggcatccacaggagcctgggtgtccactgctccaaggtgcggtccctgacgctggactcgtgggagcctgagctgctaaagctgatgtgtgagcttggaaacagcgctgtgaatcagatctatgaggcccagtgtgagggtgcaggcagcaggaaacccacagccagcagctcccggcaggacaaggaggcctggatcaaggacaaatacgtggaaaagaagtttctgcggaaggcgcccatggcaccagccctggaggccccaagacgctggagggtgcagaagtgcctgcggccccacagctctccccgcgctcccactgcccgccgcaaggtccggcttgagcccgttctgccctgtgtggccgctctgtcctcagtgggcaccctggatcgtaagttccgccgagactccctcttctgtcccgacgagctggactcgctcttctcctacttcgacgcaggggccgcaggggctggccctcgcagtctgagtagcgacagtggccttgggggcagctcggatggcagctcggacgtcctggctttcggctcgggctctgtggtggacagcgtcactgaggaggagggtgcagagtcggaggagtccagcggtgaggcagacggggacactgaggccgaggcctggggcctggcggacgtgcgcgagctgcacccggggctcttggcgcaccgcgcagcgcgtgcccgcgaccttcctgcgctggcggcggcgctggcccacggggccgaggtcaactgggcggacgcggaggatgagggcaagacgccgctggtgcaggccgtgctagggggctccttgatcgtctgtgagttcctgctgcaaaacggagcggacgtgaaccaaagagacagccggggccgggcgcccctgcaccacgccacgctgctgggccgcaccggccaggtttgcctgttcctgaagcggggcgcggaccagcacgccctggaccaagagcagcgggacccgttggccatcgcagtgcaggcggccaacgctgacatcgtgacactgctccgtctggcgcgcatggcggaggaaatgcgcgaggccgaggctgcccctggtcccccgggcgccctggcgggcagccccacggagctccagttccgcaggtgtatccaggagttcatcagcctccacctggaagagagctagggccgggcaggccgggcagctgccaccccgcccggcccgacgccccgcatgccccgaagtccctggcgcccacccggccgcggccctgcgtgtgacccgcgggtcgatacctggcagccccagtgctggggcgccgcggccctgctcgcccaggaggagagcgagggccccacactgagtctcttgaagcctcacgtttccctgggggggtgctgcatcgtcgggtgtccctcaccccacctggggaacctctgtcttcaggtcaccccttttcaggggcctgggttgctcatgtcacaagccacttttaaggcccgtgtcacctgtgtccctgtgtcctcagggcctgtgttacttcgtgccccacttctgcccagaacactgacctgttagctggctccctcctgcacaccccagagcctcctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61402 - DNA, 997 bp, Homo sapiens
tgtgcaggcatgtttgtgcatgaacatgtttgcacatgtgtgcttgattgtgtatgtgtgggtgtgcacgcgcgcgctgggtctcttgggatctgctggcaagtcagcatgtgtgtggaggcacggggagcctctgtatccctggagccctcaccaggaggctcaggagccttggagtgggaggctcagggccagccaggagagtggcccccagccctgggcagaggaactggggccatcctctgctctcccagggcagaaagggtggcccatccagggaaccaacgagtacctcacttagtgaccccagcatccaggctggcgtcgcgggtgctgggcgggaggggctctggcctgggtcctcagccctggctggacgcgggcgtcccaaggccacgtggctggccacgaaggtccccgtgccagacagccccagccgcatcccggcctcctccggaggcaccttctcctggtactcggcccagagcctgcgcataaagccactttgccactttgcagccctcatctcatgttctttgtagcggaccgagtgggtttgctataggcctcgtctgactttgtcttgcgtcttttctctgtggactcttgaggacgcctgagccccagccctgcccctgaccagcctcccccttgggtccaggggtctttcggctcatattgcagggcctgccaatgccttcacgcaccccttccccaaaggtgcccggcagggaggcagggcctcccccactcagcgcaggtcaggctaaggccagtcggctggtcactatgcaatgctgccctggggaggctccctgagggcacagtgggcgctggacccggccccccaactctcttgcctgctgcctgtgaccctgaagaacagaattgattcttgcccctctccctgtgtgagcttggccccgcctcttgccccaggcccctgctggcgggtctcaccccccacccctcgctttgaataaagcacttgcgccca

SEQ ID NO: 61403 - DNA, 916 bp, Homo sapiens
acgagcggtccgggccggcgcggctgccgctcggcgccgcggtcctcgtgccagtgagcgccgcggccgccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgaggtgagcctttgggaggggtggggctgggccaggcctccgtgaccttccctaatgccacccccaacagctggaccagctggtgatcgactctgcggtggaaaagcgtgagatggagcgaaagcacgccgccatccagcagcggacgctgctgcagccggctccctgcacaccaggcg

SEQ ID NO: 61404 - DNA, 976 bp, Homo sapiens
tacacatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctctggccacctttcctccctctgggtccctcctcacccctccccgtgttaatctgtaacttgcagcccccaggccaaagtcctttctcacactccactgcccaatagtgacctcacttccaggtcaaggtctggcgtcccaaatgaaagaagcaggcaaagggaaggagcccctgagaacaaccaatctccgctctctcctgtccatttgacctcttcttttccttctaagaaagaactaagctttgggcatttggcgattagtgaaaattctatcctgatggacttctggaaaactgtgactggggttcaagagtttaaacaggggctactggcagagtctttttgtccat

SEQ ID NO: 61405 - DNA, 721 bp, Homo sapiens
tacacatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccaggctgcccttggcatgaattctccagccagagccatctcctgagctccagggcaatgttttcaactgcctacaaaatacagttggccctccatattcatgggttctgcatccacagcttcagcaaactgcaaatggaaaaatatttgggaaaaataaaaataaaaaataacaatacaaaatgatacaaataaaaaacaatacagtatagcaactatttacagagcatgtacattgcattaggtattataagtaatctagagatgatttaaagcatatgggaaaaggctgggcgtggtggctcacacccataatcccaagactttgggaggctgaggcaggcagatcacttgag

SEQ ID NO: 61406 - DNA, 456 bp, Homo sapiens
aaaccctcagtctgagcctgagaaatcctggcatttgtagcccagggctgcgaggaagccacagggcggtccgcagggcggtatcgaggctctgggacccaaggaggggcaggacgtcgtgcacccctcgcgcacgcacctgtcgggaccggccgcctcctcctgcctacctgtcctgcctccttcgccccgaatttcaccttaaaccatgatgaaccaagcccagtggattctgaagcccgggacgatggcaggttcgagagagaattgggcagctgggggcggggcacaatattatttaggcgcctccaccccaccttcacagaaatacatctggaaagcatgggctgtcctagggctggggactgggggttacggtctcatcgatgactcagagggagagaaaaccccctgggtcccaagccaaaaagaataaaattctccagaatagccaac

SEQ ID NO: 61407 - DNA, 624 bp, Homo sapiens
aggtggaggccaacactgacctttggatggctgagttttggatgactgacagccccagatcctgctccaggttccttcctcaggaaggatcctacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccaggctgcccttggcatgaattctccagccagagccatctcctgagctccagggcaatgttttcaactgcctacaaaatacagttggccctccatattcatgggttctgcatccacagcttcagcaaactgcaaatggaaaaatatttgggaaaaataaaaataaaaaataacaatacaaaatgatacaaataaaaaacaatacagtatagcaactatttacagagcatgtacattgcattaggtattataagtaatctagagatgatttaaagcatatgggaaaaggctgggcgtggtggctcacacccataatcccaagactttgggaggctgaggcaggcagatcacttgag

SEQ ID NO: 61408 - DNA, 871 bp, Homo sapiens
tacacatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctctggccacctttcctccctctgggtccctcctcacccctccccgtgttaatctgtaacttgcacccctgagaacaaccaatctccgctctctcctgtccatttgacctcttcttttccttctaagaaagaactaagctttgggcatttggcgattagtgaaaattctatcctgatggacttctggaaaactgtgactggggttcaagagtttaaacaggggctactggcagagtctttttgtccat

SEQ ID NO: 61409 - DNA, 422 bp, Homo sapiens
atccatttctaaccaggcattggtaggagggggtgaatccacagtcccagacccaaagaagggaaactcacagccctgaggggctgctgcaggcagaggagctcctggctggctagcagcacccctactaacaggcagcccccaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaggtacatttcccctggctgggcggtggccggaaggaggcatcacaggagactcctaacaacatggggcaaaacaaagtgaccttccccagccagagca

SEQ ID NO: 61410 - DNA, 455 bp, Homo sapiens
agtggggagaggaagaaacagagtggccaaggtgggccctggctacgagtcggatgaatgcccataaatcatcactggcgagatggaggcttcagccactcacatcccctgacccagccaccttccttcctgaggggtggaaagttgaggatgtggaataatgatacaattgcccatacatcaaacactcaagctgctgtatccggaaggagtaaatggaggtcaaggaccttgagaaaggggctctggctggcaaacgccctctttctctctccccctcacttcccctctctccccaggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctct

SEQ ID NO: 61411 - DNA, 930 bp, Homo sapiens
tacacatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccaggggaggtccccaaccggggctggagacactggctggagggagagatgctgtatctggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctctggccacctttcctccctctgggtccctcctcacccctccccgtgttaatctgtaacttgcagcccccaggccaaagtcctttctcacactccactgcccaatagtgacctcacttccaggtcaaggtctggcgtcccaaatgaaagaagcaggcaaagggaaggagcccctgagaacaaccaatctccgctctctcctgtccatttgacctcttcttttccttctaagaaagaactaagctttgggcatttggcgattagtgaaaattctatcctgatggacttctggaaaactgtgactggggttcaagagtttaaacaggggctactggcagagtctttttgtccat

SEQ ID NO: 61412 - DNA, 665 bp, Homo sapiens
tatcaccagcccaaagggcaaagaacaggccaacccagaccgaagagcaaacatttgcccaccctccagcctgtgacactgttggtcacccagagtcccttttactttagcatcaataacttcactctcctgcatttctttctacttcttacatattccttcttagcctcctttgcagatcctagtcctcctattaatcctttaaactggagttttctccgcagagttttgttcttaatgtcttctcccttttgtctgcccactatccataggctaaatcatctacacccatgccttctgcttccatctataggctgcccttggcatgaattctccagccagagccatctcctgagctccagggcaatgttttcaactgcctacaaaatacagttggccctccatattcatgggttctgcatccacagcttcagcaaactgcaaatggaaaaatatttgggaaaaataaaaataaaaaataacaatacaaaatgatacaaataaaaaacaatacagtatagcaactatttacagagcatgtacattgcattaggtattataagtaatctagagatgatttaaagcatatgggaaaaggctgggcgtggtggctcacacccataatcccaagactttgggaggctgaggcaggcagatcacttgag

SEQ ID NO: 61413 - DNA, 4678 bp, Homo sapiens
  misc_feature (1488)..(1488): n is a, c, g, or t
  misc_feature (2992)..(2992): n is a, c, g, or t
acgcctgcgcagcggcgccacaggaacgatgcatgccgggaccgggaagattcagtctctgaacggcccggagtagtcgtctttccccttctgactgccgccacgctgcagtccagaatatttgaagatcaaaccgaacttgagagactaacgagaacggtccctttttattcctaacagattccttccgtggcaaagtaacccgtcgtcttccgtttccggttgcccggttgccctgttgccgtggtaaccgcacgcataacagccgtggtggttatggctggtctgagcggcgcgcagatccccgacggggagtttaccgcgctagtgtaccggctcatccgcgatgcccgctacgccgaggcggtgcagctgctgggccgagaactgcagcggagccccaggagccgtgccggcctgtcgctgctaggctactgctactaccgcctgcaggagttcgcgctggcggccgagtgctatgagcagctgggccagctgcacccggaactggagcagtaccgcctgtaccaggcccaggccctgtacaaggcctgcctttatccggaggccactcgggtcgccttccttctcctggataaccccgcctaccacagccgggtcctccgcctgcaagctgccatcaagtatagcgagggcgatctgccagggtccaggagcctggtggagcagctgctgagtggggaagggggagaagaaagtggaggcgacaatgagaccgatggccaggtcaacctgggttgtttgctctacaaggagggacagtatgaagctgcatgctccaagttttctgccacactgcaggcctcgggctaccagcctgacctttcctacaacctggctttggcctattacagcagccgacagtatgcctcagcactgaagcatatcgctgagattattgagcgtggcatccgccagcatcctgagctaggtgtgggcatgaccaccgagggctttgatgttcgcagtgttggcaacaccttagttctccatcagactgctctggtggaagccttcaaccttaaggcagccatagaataccaactgagaaactatgaggtagctcaagaaaccctcaccgacatgccacccagggcagaggaagagttggaccctgtgaccctgcacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgacgtataagttcctcacaccctatctctatgacttcttagatgccctgatcacttgccagacagctcctgaagaggctttcattaagcttgatgggctagcagggatgctgactgagcagcttcggagactcaccaagcaagtacaggaagcaagacacaacagngatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccaaataggaaaatgtaccatctctgcattgtgaatttggtgataggaactctttattgtgccaaaggaaactatgagtttggtatttctcgagttatcaaaagcttggagccttataataaaaagctgggaacagatacctggtattatgccaaaagatgcttcctgtccttgttagaaaacatgtcaaaacacatgatagtcattcatgacagtgttattcaagaatgtgtccagtttttaggacactgtgaactttatggcacaaacatacctgctgttattgaacaacccctcgaagaagaaagaatgcatgttgggaagaatacagtcacagatgagtccagacaattgaaagctttgatttatgagattataggatggaataagtagttatgactgatagtggcttttttcaaaatggctttcttacgtaccacacttttttttatctgtatttagccttggcatctttatatttgtcttattttgaatcttatccactttgtaagaacaagtttatgtttgagcaactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaagcactgttagtacgggtatgtttgcatttggtcactgatatgtaaatgactgctagcccacggctggaccacttctcaatcagcaaataaagccatgtctattttgctatctcagcatagactatgctgtctgataaatctaattcttaactctatttctccagttttttagtcctttaactttctggattgcaacgaagtctagtttagacctctaagcccttttagaagtacaagtataatgggaatttcttttcttggttcttttcaggttatgaggtttggtcagtgacaaaattttttttcataatttggttgattggttgcttcttaagttttataataaacgtttttcttcatgttctatttttgattttacanaaatgattttgcctccttgtggatactgacatatattaagtgtggaagcttattaatatttttggttttttaaaaactgaaatttttaatttttactttttaattttttaggaaaaataagcactgaactgagaatgagaagaataaaagtatgagttccataccttctaattttaggctgtcagaaattcctttattctttgggatttcacaatcatttgaactatcagaagcctttacaattacttttagctgtaacatccgattctgtataagccacatagaaaaaagttgcctttctttttttatgacctggatatataagcaaatcagctaggaaatatataattgtattttatattaatgttttctaggattttggcttacagtaaatgttagcccctatggtaagtgattgttattgttggatgttatactgattattaataagaaatttggatttttgcctttttacctggaatttttgcttacagccgtagctatgaatatatatagggtggtccccagtctctgttatggttgcgcataaattaataattttataagtatttagaaatggtataattctcttaacttcctctttcagtttttgtactaatgtttgtttttgttcgggaagaggagatttgcttttaatccttccaaaaaatgatgaaccaccgttccattcagtagtttgacaagctgttataatgtgtattttttcctcaattattcttgaaatatttagagcctctcctgcttctaacatgaaggcctttagatgccagtctgccagaaatctggaaacagaggaaccggtgaagtgaagatgtaatggagatttagctaatgatgtacttcacaatccaccttggatctcctgcatgtccaaatctcagtagttaatcaagtgtctgctgccattaacagaacagaagtaatggataacagaatggaaataagagatgccagaactacttccataactaactcaccaaatcaaatcatcagtcctcatattcttgttttatttaatacaaggagaagaggccatgcactttccaaaaggtcaaagccacatagaataggaaggcaatctctagtttaaagctttctcttggagtgttttctccccctgtcttcaaagggtctacttgagagatagtggtgtttactgctgcagcatgtatcacaagataagaaatgaaaaatcaatctttcttaccaccctgttctctttcccttttttatcttttcccttttgtcaattatagaattatagggacatttttctctgatagctggaagttgaacctcaaccaggtataaaagatgcataacaaccttttagcagtaagtgtcaagtgagtgagcactatgattatcaaggtgactttggaaaccttttaaaaatgcatttttgcaaaacaagataacatatattgataaaaagtgactctcagattggtaatgccagaaaaaattttaagaggactcaccaaaagtactagatctatgtaagttgtagaatagagtgaagtttttttatatatttgtggtagcctccatcttttaaactttttgaactcagtagaaaaacagactgaaattttaaagacatgcagtatttgtatcattttaaattctgtaacactgggaattaaatatactcaactttagagg

SEQ ID NO: 61414 - DNA, 5225 bp, Homo sapiens
  misc_feature (1488)..(1488): n is a, c, g, or t
  misc_feature (2992)..(2992): n is a, c, g, or t
acgcctgcgcagcggcgccacaggaacgatgcatgccgggaccgggaagattcagtctctgaacggcccggagtagtcgtctttccccttctgactgccgccacgctgcagtccagaatatttgaagatcaaaccgaacttgagagactaacgagaacggtccctttttattcctaacagattccttccgtggcaaagtaacccgtcgtcttccgtttccggttgcccggttgccctgttgccgtggtaaccgcacgcataacagccgtggtggttatggctggtctgagcggcgcgcagatccccgacggggagtttaccgcgctagtgtaccggctcatccgcgatgcccgctacgccgaggcggtgcagctgctgggccgagaactgcagcggagccccaggagccgtgccggcctgtcgctgctaggctactgctactaccgcctgcaggagttcgcgctggcggccgagtgctatgagcagctgggccagctgcacccggaactggagcagtaccgcctgtaccaggcccaggccctgtacaaggcctgcctttatccggaggccactcgggtcgccttccttctcctggataaccccgcctaccacagccgggtcctccgcctgcaagctgccatcaagtatagcgagggcgatctgccagggtccaggagcctggtggagcagctgctgagtggggaagggggagaagaaagtggaggcgacaatgagaccgatggccaggtcaacctgggttgtttgctctacaaggagggacagtatgaagctgcatgctccaagttttctgccacactgcaggcctcgggctaccagcctgacctttcctacaacctggctttggcctattacagcagccgacagtatgcctcagcactgaagcatatcgctgagattattgagcgtggcatccgccagcatcctgagctaggtgtgggcatgaccaccgagggctttgatgttcgcagtgttggcaacaccttagttctccatcagactgctctggtggaagccttcaaccttaaggcagccatagaataccaactgagaaactatgaggtagctcaagaaaccctcaccgacatgccacccagggcagaggaagagttggaccctgtgaccctgcacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgacgtataagttcctcacaccctatctctatgacttcttagatgccctgatcacttgccagacagctcctgaagaggctttcattaagcttgatgggctagcagggatgctgactgagcagcttcggagactcaccaagcaagtacaggaagcaagacacaacagngatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccaaataggaaaatgtaccatctctgcattgtgaatttggtgataggaactctttattgtgccaaaggaaactatgagtttggtatttctcgagttatcaaaagcttggagccttataataaaaagctgggaacagatacctggtattatgccaaaagatgcttcctgtccttgttagaaaacatgtcaaaacacatgatagtcattcatgacagtgttattcaagaatgtgtccagtttttaggacactgtgaactttatggcacaaacatacctgctgttattgaacaacccctcgaagaagaaagaatgcatgttgggaagaatacagtcacagatgagtccagacaattgaaagctttgatttatgagattataggatggaataagtagttatgactgatagtggcttttttcaaaatggctttcttacgtaccacacttttttttatctgtatttagccttggcatctttatatttgtcttattttgaatcttatccactttgtaagaacaagtttatgtttgagcaactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaagcactgttagtacgggtatgtttgcatttggtcactgatatgtaaatgactgctagcccacggctggaccacttctcaatcagcaaataaagccatgtctattttgctatctcagcatagactatgctgtctgataaatctaattcttaactctatttctccagttttttagtcctttaactttctggattgcaacgaagtctagtttagacctctaagcccttttagaagtacaagtataatgggaatttcttttcttggttcttttcaggttatgaggtttggtcagtgacaaaattttttttcataatttggttgattggttgcttcttaagttttataataaacgtttttcttcatgttctatttttgattttacanaaatgattttgcctccttgtggatactgacatatattaagtgtggaagcttattaatatttttggttttttaaaaactgaaatttttaatttttactttttaattttttaggaaaaataagcactgaactgagaatgagaagaataaaagtatgagttccataccttctaattttaggctgtcagaaattcctttattctttgggatttcacaatcatttgaactatcagaagcctttacaattacttttagctgtaacatccgattctgtataagccacatagaaaaaagttgcctttctttttttatgacctggatatataagcaaatcagctaggaaatatataattgtattttatattaatgttttctaggattttggcttacagtaaatgttagcccctatggtaagtgattgttattgttggatgttatactgattattaataagaaatttggatttttgcctttttacctggaatttttgcttacagccgtagctatgaatatatatagggtggtccccagtctctgttatggttgcgcataaattaataattttataagtatttagaaatggtataattctcttaacttcctctttcagtttttgtactaatgtttgtttttgttcgggaagaggagatttgcttttaatccttccaaaaaatgatgaaccaccgttccattcagtagtttgacaagctgttataatgtgtattttttcctcaattattcttgaaatatttagagcctctcctgcttctaacatgaaggcctttagatgccagtctgccagaaatctggaaacagaggaaccggtgaagtgaagatgtaatggagatttagctaatgatgtacttcacaatccaccttggatctcctgcatgtccaaatctcagtagttaatcaagtgtctgctgccattaacagaacagaagtaatggataacagaatggaaataagagatgccagaactacttccataactaactcaccaaatcaaatcatcagtcctcatattcttgttttatttaatacaaggagaagaggccatgcactttccaaaaggtcaaagccacatagaataggaaggcaatctctagtttaaagctttctcttggagtgttttctccccctgtcttcaaagggtctacttgagagatagtggtgtttactgctgcagcatgtatcacaagataagaaatgaaaaatcaatctttcttaccaccctgttctctttcccttttttatcttttcccttttgtcaattatagaattatagggacatttttctctgatagctggaagttgaacctcaaccaggtataaaagatgcataacaaccttttagcagtaagtgtcaagtgagtgagcactatgattatcaaggtgactttggaaaccttttaaaaatgcatttttgcaaaacaagataacatatattgataaaaagtgactctcagattggtaatgccagaaaaaattttaagaggactcaccaaaagtactagatctatgtaagttgtagaatagagtgaagtttttttatatatttgtggtagcctccatcttttaaactttttgaactcagtagaaaaacagactgaaattttaaagacatgcagtatttgtatcattttaaattctgtaacactgggaattaaatatactcaactttagaggacacttgccttactgtaatctataatcattttatattgaaaaatagggccagacattagccaaacggtaattaatttactagccataggtatagtgtttaatattctcttggggagtgagtctttactaagtgattactctatacttgataccactattaattgaggttcttttggttgtttaattaaatcagctcctttggatttgggccaagattgatccaccacatactgaaatccgttctacaacatcataatgtgtatttactagaaaaggacttgcttcataaggaaaaattattagaatatagagacttataagtacatttctagtgtgaaaaataagcatttgttagtttaagtgagacctgccaataacttgattgcaaatattaatatcatgtgaacatataaaatgggcccaaatccttgttcaaaagtgaaatttgcacgtttgtgaaataaaacacatcaatatcaatgactgaataccttaattcaaaacagcaaatggctaaaattatactatgcaagcaggaccctagtaa

SEQ ID NO: 61415 - DNA, 1238 bp, Homo sapiens
aatggcttgtgtttcaggactgagaactcattaacagtcccccgccgccttgtctgctcctagcgattggcctccacctccactaacactcagcccttcccttggcccttggctttttctctgcttcaaccacaggctttctctctctctctctctctcagcctcggcttctcttatagactctatcccattctcattccaagacacagaaccccttcttatctacctgaagctatagttggtcattggtatcatggaaaacaggagctgactatgccttaaaaatcatttattgcagtgatttttaaacaatgtttaaaggagccttgagattccttggtggcaagcaacagaggccaccgaatatgtgtatgtatgtgtgatgagtactcatagcagtgaatatttggaaagcagagcctccaaaagtcccttatgcacacatgcatacttatcaatcagaacaaaggactggtatttgttttatatattgggggtaattcattgcttgattttttttaaaaaaagattctgttatttaaagaaaatagtttaaatatcacagtgatcccatcctgccccttcattatctgcaggggcgcccctgagtgtccccaggtgagatctccatgcctacattactctacacagaataactctctcctggttccagtcccaaataaagaggacagagcctcatgagtctatctgggccaaagtgggttattgccaagaataacctggcatcaggggattcaaactctttgccttcaagctctggcattccagtaagggctgacttggaactgtcacagagaaactgggggacagtaaatgcagtctagcacttgtttggaactagagcatggctcaaaaatgatcacaatgaataaactttgctatcagctttctgtaaataaatatacacacaatgctaaatccttttgcattaggacttgaatttgattgtacattcttggatacctaagaatctcccaatactgctctagcttgtaactttttttttcagaaagagtgtttcctcagatgtctagatgtctgtatataagtgaacataattactatttttaagaggagggtgcctatgttcttcatgcttataatacccccaagaaacttacagagaacactatgcatgagattaaattgcaatccctaagggaatcccagactcactctggatcaacagtagttgctaatgtgtttaatgcagacta

SEQ ID NO: 61416 - DNA, 415 bp, Homo sapiens
gtcagagtgggtcttttgtgggtagacgctgggatgccagccattcattagtggcctgagctcactgaccaggcagcaaagccagcctggaaaagagaaatagttagttttcatttcaaccaaaatggaaacaaattgtttttgtttacgatggagactgtgcaatatataattatccaacacaattgtggttttattgctgaaagggagctgttttatctcttccctttatgtttggctacacagttacacacacacacacacacacacacacccttttccatccctgcctgggaattcccattagagcagtggctctcaaattgtggtgaagctcagttttgtttttaattttgaaaccttgcaaatcaatgcttttatataacataataaattaacactgtgtatatcaata

SEQ ID NO: 61417 - DNA, 179 bp, Homo sapiens
gtgatcctcctgcctcagccttccaaagtgctgggattacagatgtgagccatcacgcctagccacctggtccacttttattccttcaaacacaccagctgtttccagccttctggactttgtctcttttgttaggatgcttctctcctttttatggctgaaatgttgatatctcagaa

SEQ ID NO: 61418 - DNA, 328 bp, Homo sapiens
aatacagtttgagaggctagaaccgtggatttcaaatgctagcctgtatgagggtcccttggagggcttcttaaaatacaagttgctggttgtcattttcagggtttctgatttacgaagtataggatgggcctgagaatttgcatttccattaaattcccaggtgatgtggctgctgctcctgggacaacatttagagaaccgctagattagacagtctcacaacagggatttctagggacagcttaatggttactttatgatttgaagctggaatacccaattaggggtttttccagtctcatttcatttcatttcatttgcttcc

SEQ ID NO: 61419 - DNA, 385 bp, Homo sapiens
aacctgggtgacaagagtgaaactccatctcaaaaaaaaaaaaaaaaaagaaagaaaaaaaatatgagaaagaagtgttagaatttttatttctatttatttttacttaaaaataggagatatagccaagatatagaaacttatacatatcatatatatgaatgaggcatcctgaggggcgaaaaatgcaacttgtttgttacactttccattttcagcaaggtggattaatggattatgtagtctgattttaaactaacttcataatattgacaagtggcttaaaaatttttccacatatagcttacagattgaagattgcattaatattgcaggcagaaacaagaaaagggcagaatgagtacctgtccaattcttcgacagt

SEQ ID NO: 61420 - DNA, 465 bp, Homo sapiens
attcacttaaattttgtagaaatttaagtatatataattgtataataaatgtagaaaaaatattaactacatttttttatatatacttaaaattttttttaactttcactttctgcttttgtatatttatagtcttttgtgaattggcttttgttctctaaagcccatgtgaggttcttgtacctcacctctctcccagtttataaactttatatggcaagaattttgatccttttcgtgttgcaaacattattcctggcttgtatctcttggtcttgtttggctgatggcatgtttttgtaacatagagacttttctgtagtcacatctgtcaattcattttctgtgtttcatattatgcttaggcctttcccacccccaggacaataaaaacaatgttttcttctagtaattctagcacttagccaggtataatatgtcggaatcttttcccaaatgtatagt

SEQ ID NO: 61421 - DNA, 278 bp, Homo sapiens
ttgagcgcttcccactaaccagttcaatattttgaagtagttgatttccttccctgtgattccgacctggactctgtctttcaaaaacaagcacaatcacaatgtgtgtctcacccaattgctgaaataaggactgagctctcctacagtagtataggacagtaagagtcacctaggatggataaaagtatcgttgactagctggaaatctgtgtaatcacgaagtttaagaatgtttctcatttcatgtacatcatcaatcccagaccctcagcatc

SEQ ID NO: 61422 - DNA, 617 bp, Homo sapiens
gtgggaggtttctgttcatttgcaaatgcgatgacattttcagctttttgtaccaggaacggaagcaccttgggaagcttggggttgaatgcattctccctagagagcagcaaattaggttaaattcatttactgatggaggctccaggggaagggggaccctggggaggagggggcagatgatgtgtggcagtgacttattctagtttgaattgacttagaaaaaatgtatttatttgcttcctttctccaaccttcatcatttcctccaaagactgcaagcatagacttatacaacatgtcctctttgcagaaagctgtgaggtggttgtgtgctcttgacctgagggagcaggcccagaatcaatgaatgtgtgtgtaattaaactccaggggatgagacacccgacttcatccaaattagagattcaattcaacagcaagtttgataaaaagggaggtcggtagtgaccaaactaaccctgctacgtcgttaacgaggctgaagatgattccaaaatggcttaatgtggcagaagtcttctcacaagatggctatgattcaaataaccttggacagctgtgatggaagagcaaataaatagctccttttacaa

SEQ ID NO: 61423 - DNA, 345 bp, Homo sapiens
ctggaaataagaaaagctctgagggtctccaaagttaccagaggaaggctgaattttatgaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttggtgagtgccaaaaagtgtaactc

SEQ ID NO: 61424 - DNA, 2789 bp, Homo sapiens
  misc_feature (515)..(515): n is a, c, g, or t
ctggaaataagaaaagctctgagggtctccaaagttaccagaggaaggctgaattttatgagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggtttccggagagaccgaactctgctctcagcacctttcccagccgctgttgctaaactgacctcggaggacgagaggggaaggaggtgcgacgccccttacatcagtacanaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacaaaaaaaaa

SEQ ID NO: 61425 - DNA, 1925 bp, Homo sapiens
tactactactaaattcgcggccgcgtcgacgcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacaaaaaaaaa

SEQ ID NO: 61426 - DNA, 2757 bp, Homo sapiens
  misc_feature (515)..(515): n is a, c, g, or t
ctggaaataagaaaagctctgagggtctccaaagttaccagaggaaggctgaattttatgagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggtttccggagagaccgaactctgctctcagcacctttcccagccgctgttgctaaactgacctcggaggacgagaggggaaggaggtgcgacgccccttacatcagtacanaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatacagtccatgcatctgccattttaaaaagtctctcatcctatagcagataaaaccaagtatatttcggtcgacg

SEQ ID NO: 61427 - DNA, 1852 bp, Homo sapiens
  misc_feature (515)..(515): n is a, c, g, or t
ctggaaataagaaaagctctgagggtctccaaagttaccagaggaaggctgaattttatgagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggtttccggagagaccgaactctgctctcagcacctttcccagccgctgttgctaaactgacctcggaggacgagaggggaaggaggtgcgacgccccttacatcagtacanaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacgttttctctctcgagactgctatctaccacactgaatacaactctgaaaatgctgacaattctaggattcggtactcccttattaaggctttattcctatgccaccact

SEQ ID NO: 61428 - DNA, 1112 bp, Homo sapiens
  misc_feature (515)..(515): n is a, c, g, or t
ctggaaataagaaaagctctgagggtctccaaagttaccagaggaaggctgaattttatgagtctagtcctcaactctaaccaaagtaaaggaaactggaaagacacacgctttttcagtcattaatagaaagttgtccagaaacccggcgagtgaatctacccagagctgaagcttcctttgcaacttgggaacaccagggccacagtgactttgtggcttggctttagataaatttgaccatggctgtagaacccagcagctcagaatccattaaaaggagagctgggaggaggctcctgccatacgccagacagttttgtagacacgaaggatccagagattagcaacacctttaccatttttggtgacagttaagcacccatctaagaagttttctttgggtttccggagagaccgaactctgctctcagcacctttcccagccgctgttgctaaactgacctcggaggacgagaggggaaggaggtgcgacgccccttacatcagtacanaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgagaaagctgtgaggtggttgtgtgctcttgacctgagggagcaggcccagaatcaatgaatgtgtgtgtaattaaactccaggggatgagacacccgacttcatccaaattagagattcaattcaacagcaagtttgataaaaagggaggtcggtagtgaccaaactaaccctgctacgtcgttaacgaggctgaagatgattccaaaatggcttaatgtggcagaagtcttctcacaagatggctatgattcaaataaccttggacagctgtgatggaagagcaaataaatagctccttttacaa

SEQ ID NO: 61429 - DNA, 656 bp, Homo sapiens
ataccagtaaagatgtcatctggccaatttgtgtgaaaaaagagaataattctcatccaaaccgcctgtctctggaaataagaaaagctctgagggtctccaaagttaccagaggaaggctgaattttatggtgattgataatatttccaagcttatggagaaaaaaatatcattagtcttttccatggtagaaaagagtaaagcctgtaacaaaaaaagtgatacagtggatgggatgatgagacccttgaaataagcaaggatggaccagaaactggtaacactcacccatggaatttcattatgaagtcgtggcaagggccaagccgacctggatttgaaacccatctcttcaacgatgtagattttgacaacatatttgatttctctgggcctcagtttgttatctgcacaaaagggagatatgagtggttacgttattggattgtcatgaacattaaataggataatgtcaaatcattcagccaagtttctagcatatagtacaggttcaaatattatcttttttttcccaccaacctcttttccaggaaaatgcaaagctactctttagccaaattttaaaacaggggatatttattttgggaatcattaatacccatctgccccttttttggtccattggacatattga

SEQ ID NO: 61430 - DNA, 2596 bp, Homo sapiens
  misc_feature (7)..(7): n is a, c, g, or t
  misc_feature (322)..(322): n is a, c, g, or t
atctctntgtgagaagctgccatctccccgccacccgctcgtccccttctctttctgccaccctcctttccttcctccctcgctccactccactccctccctcttttctcagtaccctcctctttactctccgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgccccttacatcagtacanaactaccacaccaaccacctccacttcaaagccggattttgcatcctgggggcgggacagacctcgtcccgggctgaattctctctccactcttcgagattggcacacccagaatgaagaagatgagcaacatttatgagtccgctgccaacacactgggaatctttaacagcccctgcctgaccaaagttgagctgcgtgtggcgtgcaaaggcatttctgacagagatgccctttccaaaccagacccctgtgtcatcctcaagatgcagtctcatgggcagtggtttgaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacaaaaaaaaa

SEQ ID NO: 61431 - DNA, 1497 bp, Homo sapiens
  misc_feature (14)..(14): n is a, c, g, or t
cgtaagtgtctctnaccagatactgagtgatatagcattaaagaagtcagacgtgcttcttactttcatggagcttaaacttggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccaggtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacaaaaaaaaa

SEQ ID NO: 61432 - DNA, 1162 bp, Homo sapiens
agcgggggtctcacagaatgaggctttgaagcctgtcctcctaactcttggcctgctgctctttctttgtaactgtcagtgaggtagttattataattaagctataattgccatgcctacctttaagctccattcatcagaaccctaagcctttaggactatcagcacattcaaaaaatgtctgtcatcactgttgctttggtcaatgtgcagtgaggccacctgggtgtctaactggtattgtattgtccttgtctccctcacctcttcaccccccaatcatcatggggcatctgactgcagcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacaaaaaaaaa

SEQ ID NO: 61433 - DNA, 441 bp, Homo sapiens
gaaaaatgcacagcctcaccagctattaaacatatggaaatgatgacaatttaaagcttataaataacattagcggtggcttggatttattgttgtggcctccggaagaacttgggcacagtgtaacttcctggggcccgaggttgttaatcggtgaattgttcatgaaggacagtgctcactgtgaaggtgggtgtcctgggatgctctgcctggcccgcgggagacaaggctatggtctgacatccctcagcctgtcctcattgtcctggctctgagaagaagctacaaaacacagtagaagaaaaagaaaacagtcttttaaagacttgtaatgagttgttaatgataaaagtaacacatgccaactggaaaaatgtgaattttttatctcagccaaaagtataaagatacttcgatttctttaaaaacttatggaaa

SEQ ID NO: 61434 - DNA, 545 bp, Homo sapiens
agtgaaaaccttttattacagtaaaaatggcaaactctttcattctcttagagaagaattggtcacttacatggtctcggttctgagaaagtaagatgctaacagtctcgataaagggctaatcttaattaattgatttttttctgttttaatcccacagcttataaataacattagcggtggcttggatttattgttgtggcctccggaagaacttgggcacagtgtaacttcctggggcccgaggttgttaatcggtgaattgttcatgaaggacagtgctcactgtgaaggtgggtgtcctgggatgctctgcctggcccgcgggagacaaggctatggtctgacatccctcagcctgtcctcattgtcctggctctgagaagaagctacaaaacacagtagaagaaaaagaaaacagtcttttaaagacttgtaatgagttgttaatgataaaagtaacacatgccaactggaaaaatgtgaattttttatctcagccaaaagtataaagatacttcgatttctttaaaaacttatggaaa

SEQ ID NO: 61435 - DNA, 392 bp, Homo sapiens
tttttaatgtgaaataatgattacatataaaataaaagcaatatccaggctcaccttggagattgtgcaggctcagttccaggtcatcccaataaagagatatagcaataacataagtcacccaaatactttggtttcccaatgcatacaaaagtgatatttacactataatgtggtctattaagtacacaatagtattatgtctaaaaaaagtataaacattaattttaaaatgtattgctaaaaatgctaacaatgccttcagtgagtcataatctttttgctggtggaggtctcctccacgtagatggctgatgaatgatccgggtggttggggtggtggtggcaatttctgaaaataagacaagaataaagtctgttgcatagatcga

SEQ ID NO: 61436 - DNA, 292 bp, Homo sapiens
acatcagaatctcatcgtttcttacctctatcactgctgtcatccttgtccaaactaacatcatctcttacctggagtctccttgtccttgccccattgggtttattctcaacataacagccaaaatgatcctgttaaaagatatcagattttgtcactcccctgctccaaatcctcacatgatttctcagatcactttgtgtaaaagtcaaatatcttgcacaaaaattgtcaacctagattcgttttgagtagattttatatattctaggccctctgtatctgtggtttc

SEQ ID NO: 61437 - DNA, 353 bp, Homo sapiens
ctttgcctactctagaagttatctacatagagaaaatgaatatttgattcaagtatgcaattggcattttttaagatttccatgccaaaatttgctctctttggtcatttccatctgtccttggccactcttataatttcctcttacttgcatctttccccttccccttaatatactccatcctttcaacctctgctttttctatcactgtaccctcctcttaaaaaatttccttcttggccgggtgcggtggctcacacccgtagtcctagaactttgggagactgaggcaggtggatcacttgagcccaggagtacaaacctgggcaacacagtgggaccccatctctata

SEQ ID NO: 61438 - DNA, 399 bp, Homo sapiens
cttcagtattagccttctattggaatgtaaattattctgacttgaacccacactgaactgcctgcagcctgtaacttagaaggaaaaaacaaagtgccaccactgaactgctggccttctaacaaatatcacctattagcattcacaatgaaggcaagcatgaatcagcatgaaagtataccctatataaggtttcttttagcttctctcaagtcttgacacacacctgtgtcactgacagctagtatgcaaattgcctaaaagctccattaggctagtctagggcaaggaagcccatctgttcgttccgtggacactttccctcctaggatcctcatgtggggaattatgtccttggagacatggcagatggatgaatttgcgccagtgtctggtacc

SEQ ID NO: 61439 - DNA, 311 bp, Homo sapiens
gtatgtctggtggtcacactgctactcaagtgaaaagaataagaaccattgcaatctgtagtgcattttccctgtaaccgagagcgggctttgcttcacctctcatttaggctctagtccatgctggaacatcggagttagctcagcttagtccctcatgaagaaatatttcaacctgaatgggttttctggtgacagtctcattcatttccccttcttgggttaatttgctaaagctcacatcttaagaatatttgggactgatacacaacatgtgataatggataatggatagatttccataatatcaa

SEQ ID NO: 61440 - DNA, 331 bp, Homo sapiens
ctgcacccttcagtccacttagaggaccgttgtgtcacagcaggattggtgttcccgtcaaatgacatcctgtataccgagttttagaaaagcacatgagtgcacgtaacgggatgtagaaaagctattttcaagcatagttaaatgtggtgattttggaagccttcttcacttaactatgaggaaaattcattatcaccaacaaacatcttatgagagtagtatatcagcctaattgccatccctgacctcccatggtgagctgacgtgtaataaaaacaaaaataacaatagcgtgctcatagtactgctgattcctaccgtaggagct

SEQ ID NO: 61441 - DNA, 1370 bp, Homo sapiens
gacctttctttagtagaagacagtaagagaatactgttggctctgggaactaaccatttgagctgtgggacccagggaatctctcttgtaagcatcatctttagtgggtgactcctggtggccctcccagctctggtggtgctgtggggacctgccttggagatgccttggtactagtaccttttttgtaccaggccatgagcctagggcacagggcctctggcctgcagatttcaggaaggcagctgtgttgtgtgaaccgatacagcctgccagcacttctgtcccgagtgactgtcgttgtcatcgttagcatgttgcctgaaaagccttggggtctgggcgctgacactgaagcttttttttcccttctggctctgtgatgtccagcattacccagaacgccatggaggaccagagcgccacggccgggactcccgcgatggctgggggggctatggctctgacaagaggatgagcgagggccgggggctgcctcctccccccagacgtgactggggggaccatggccgaagagaggatgaccggtcatggcagggcacggccgacgggggcatgatggacagggatcacaagaggtggcaaggtgaggagcagctctgggctgggaccaggatgtgctggggagtgatggaaagatggaggccgcgccttctctccttgggggagcacaggaggtgctctgctctcagtgctggaatgaggaatgaagagcactccagacaccgcctgctctctggtggtctggcccaggagttggacagtgggcgttcccgagttctctctgctgggaggaagcctggacgtctatggtccctgtgcccaggtgtcttcctgggacccgctagttgtgggtacctgggggcctcaccaaagggagtggagtgggctaaatgtgccgtgggttccacgccgtgtgcgcaagttccctgtgtgaaagcacgtctgtcttccaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttatttaaagtg

SEQ ID NO: 61442 - DNA, 382 bp, Homo sapiens
ccaaaggtacaacagatttactacatttaagacaggaatcttttctaatctctgtgcctattaaagaagccacctgcttagaagtactttgtagatgaaaaaatacttatgaatccactgtaacttcacaatcttgaatgccaaggaaaaactttactagtttcatttaccactattctttaaagttctttttgattttatgttttaaattttttaattttatattttgagacaaggtcttgctctgttgcccaggctgcggggcagtggcataaacgtggctcactgtcactttgacctcctgggctcaaggaatcctcccatcttagcctcctgagcaactgggaccacaggcatgcaccatcatgcccagctaattttt

SEQ ID NO: 61443 - DNA, 905 bp, Homo sapiens
catgcccggctaatttttgtatttttagtagagacagggtttcaccatgttggctaggctagtctcgaactcctgatctcaagtgatccgcccgcctcggcctcccagagtgctgggataacaggtgtgagccactgcgccctgccagctttgacttttagcaaatgactgagtcacctcgtgaaaactctgtaaatagagagtaatcaaaccaaacctgtggtatatttcacacggttaaatgagatcatgtaagtgaatactgtctggacaaaaagtaggtgctcaataaatgtcagcttctttattcgccattctgccagtacatttaagatgaaaaggtctgctttcaggggtttgtgctgttcagtcttactgtgcttctcagaattgaaaacagcatttagaaagacgtttttatataattattcatcttgtaaggatgcaagtgtcagaatctatttttaatccaacaaccagcttttctgtagtgttttaacagtttacaaatgttaactttccattctctctagggagatgagagaaatcgataaaaggcgattacaagtgaatactcctatagcaatacttgatacattaaattgtttaaaagtgttttttttcttcttcctcttctagttgcagtaatacgaggtttctaaaggccatacgtaactgtgtacataaagaggaaagctacttgggatagaaggactctcagattgggttttaacttctcaagtataaaaataagacaagtaggcaaaaatatcacattctgaagttttaagtgacagataaacaaattcaacatgcaccaccaactttttgagttttaggtacactaacttattgtgggatctgggccagctgctctacctctgtagacatttctaagtgggaaa

SEQ ID NO: 61444 - DNA, 269 bp, Homo sapiens
cattcaataagcccatttattaaattccatcaatatgtcatctcctcttctaggtactatgtcacccagcctgggtgacagcatgagactccatctcaaacaaaaaagtttaagtaagctcccagctgagacctaaagtatgagaagggaccagtggggaaagaattgcagggaagagcatccaggcaaagggaacagcttatgcaaacacacagattccaggggaaaagaactaggggacagtgaaattggaggaggtgaggcagcac

SEQ ID NO: 61445 - DNA, 104 bp, Homo sapiens
acaaatatcaggaaagtaattttatacataagctagataattgcctatagctgcgtatgctgtgaaataatttctgtttgaaaagacaggaaaaattatatggc

SEQ ID NO: 61446 - DNA, 378 bp, Homo sapiens
atgaacatatccaaggttctattttaaggccaagggatggggagtggtgagtgggcctatgttaggaggtcacacagatatataccagctttttatttacatgatcaacgggacttcatttttttctccagtccctcctgtgtttgacattaagacagcttaatgtgaattttaagtgcaataatgtgttgtttacccttaatgataacttttagggaatatttatacccctttaaaaaagttttgggcccacaatagctagattatttcgtgttttacagttatattttttacttaacagaaaatcacaactaacaataaacttttatggtgaatatagtttgttatcttagtgggactgttaagaaatttgtttat

SEQ ID NO: 61447 - DNA, 408 bp, Homo sapiens
cagaaatatttcagtattctttagaccatgccacataagctcagacaagttcaaatagctagtatatagcaagtctgtttctctggattgcatttgcaaaaattctgcatgctcagcagtgctaggaagctctataaaatgatggtgcaacgaaaaatcatcccaatgaggttaaaaaaggagatgcatccaaagagttcctacctaatgaattttctgagtttcagatgtatatatgtgtatgaaagctatgagtgatcatggaccaatacaactgaagagaacaagagaatctcgaggtcacagcaaaaaaaagtaagatgcagaaaggattgacatttcctgggactaaatgcatttcacttttgttttaatcacaaagtaaaacttacttatttgcttctgtca

SEQ ID NO: 61448 - DNA, 292 bp, Homo sapiens
ggccctgattttcaaccatgtgattgtttcactcctggactatgacttttggtgggagatggaagttttttagagaactgagctgtggaaaaatgacctctccttaacaacttgaagctatttttaagatttgagggtctggaccaaaagaaaaggagcatcaggttaagtcaaggtgacagataaggttgagagtaacgactaactccaaagatggcttccctgaagaaaagacatttgaagattttttttttcttaatcttgtcagaagatcccagaaaagttctgattt

SEQ ID NO: 61449 - DNA, 245 bp, Homo sapiens
agtatattagggtacactgggttggcatctacatagattctaggtggagataaaatcctgacagctgtatagtttcatgattatgattttcaggtgaaatatacagcctgggagaaatgtaatgtttgaggatatcggagatacggtgcctataattactacacaaaaaaacctaagagggcattagtatattagtttttatcttcaagtttaccttactcttcatacatgtcactgatgctaag

SEQ ID NO: 61450 - DNA, 1938 bp, Homo sapiens
ggtagggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcccggagcccatgcccggcggctggccagtgctgcggcagaagggggggcccggctctgcatggccccggctgctgacatgacttctttgccactcggtgtcaaagtggaggactccgccttcggcaagccggcggggggaggcgcgggccaggcccccagcgccgccgcggccacggcagccgccatgggcgcggacgaggagggggccaagcccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccaggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaatta

SEQ ID NO: 61451 - DNA, 1936 bp, Homo sapiens
ttgcggtgcgaggctggtgcgaatcggccgaggcgtgctgcgcggtgtgatgcgaccggaggccaggcccagcacgccggagctggcctgctggggaggggcgggaggcgcgcgcgggagggtccgcccggccagggccccgggcgctcgcagaggccggccgcgctcccagcccgcccggagcccatgcccggcggctggccagtgctgcggcagaagggggggcccggctctgcatggccccggctgctgacatgacttctttgccactcggtgtcaaagtggaggactccgccttcggcaagccggcggggggaggcgcgggccaggcccccagcgccgccgcggccacggcagccgccatgggcgcggacgaggagggggccaagcccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccaggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaatta

SEQ ID NO: 61452 - DNA, 1412 bp, Homo sapiens
taagatgtggacatcgagccttcaacgtgggtatttttctcctggaatcttagtttcttcatttgcaaaaagtagacaggaacttctcccctgcggggttgcaatgggaattggagaaaatatatttcaagtgccttgcgcgatgcacggcaccgaggcacttggcggcactcaatatctgggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaatta

SEQ ID NO: 61453 - DNA, 1503 bp, Homo sapiens
taagatgtggacatcgagccttcaacgtgggtatttttctcctggaatcttagtttcttcatttgcaaaaagtagacaggaacttctcccctgcggggttgcaatgggaattggagaaaatatatttcaagtgccttgcgcgatgcacggcaccgaggcacttggcggcactcaatatctggtattgtttggctattattactacttcttgggctgatcatgctccgatgcttctctcttaaccccttgcttttttttctttcggccctcagggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaatta

SEQ ID NO: 61454 - DNA, 1336 bp, Homo sapiens
ggtagggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcccggagcccatgcccggcggctggccagtgctgcggcagaagggggggcccggctctgcatggccccggctgctgacatgacttctttgccactcggtgtcaaagtggaggactccgccttcggcaagccggcggggggaggcgcgggccaggcccccagcgccgccgcggccacggcagccgccatgggcgcggacgaggagggggccaagcccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccaggtgggtttggagccccccagggtttgaccctttcggggaaacaccaccaaaggacggacacccgtgtaagccgggagggacgcgcccttttcaaccaacgggcggcaggggtttggtgggggcgcgcgctgggacgcggacaaagggttcccggccaagaatgggatgggtacccctgtggtcccacttcagacccggaacgcggcaggggggagttcactccaaggttcggtttcagcgctttaagttgtggacgcatgcgcgccagcgggtgggaaaggattgttgggcgtcccaagagaaccccggccggcgccaaggggcaaacgaaggacctaccgaggaggggcagcatgtttgggagcaatcgctggaagtttgggcctgccaaggcctagtggttggcccgcggggtggcttgggcgcctcttctttcccttttgggggggccccggaattatgtacgggcccgaggagggtcgctccgcatctacggggcgctggggccccttcaggagcgcgggtagctgtggcgccgggggaaccttaccggccgtggtggtcaacgtgtccctgattgaggcccggccccatttggaggttctccgctgggtgcccgatgcccggg

SEQ ID NO: 61455 - DNA, 829 bp, Homo sapiens
agcggagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagatttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataacaggaaatgttgttaagttttctgctggaaaagtgaaattaaaattgctgaaggaacagattcaagagccagtgaaaccaaagttaattataaaatggcaaattcttcagaatgtgaaaaacccaagataaatgggaaagttgtggacaggtgagaacaaagctgttctactggtatgccttgaatgtggagaagattatgttcaggatgctttgctaaagttcacaagaa

SEQ ID NO: 61456 - DNA, 747 bp, Homo sapiens
agcggagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcagaagtgtttacaaatcagaataacttttagacaatattaaggtggtaatcatgaacagaaaagatttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataacaggaaatgttgttaagttttctgctggaaaagtgaaattaaaattgctgaaggaacagattcaagagccagtgaaaccaaagttaattataaaatggcaaattcttcagaatgtgaaaaacccaagataaatgggaaagttgtggacaggtgagaacaaagctgttctactggtatgccttgaatgtggagaagattatgttcaggatgctttgctaaagttcacaagaa

SEQ ID NO: 61457 - DNA, 791 bp, Homo sapiens
agcggagctatccgcggccatccggcggtggtgacgcgagaggctggggtctccaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagatttgtagttcttccatggggaaaacctggaaattctgtaaagctaaaatatagcaatgtaataattaaaacaaaagtctaagatttgaagagataatttgcttcaggattttgatggaaggcaaatgctaactttaaaaaccagatttcggagaagtacaaaagaaatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataacaggaaatgttgttaagttttctgctggaaaagtgaaattaaaattgctgaaggaacagattcaagagccagtgaaaccaaagttaattataaaatggcaaattcttcagaatgtgaaaaacccaagataaatgggaaagttgtggacaggtgagaacaaagctgttctactggtatgccttgaatgtggagaagattatgttcaggatgctttgctaaagttcacaagaa

SEQ ID NO: 61458 - DNA, 946 bp, Homo sapiens
agcggagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagatttgtagttcttccatggggaaaacctggaaattctgtaaagctaaaatatagcaatgtaataattaaaacaaaagtctaagatttgaagagataatttgcttcaggattttgatggaaggcaaatgctaactttaaaaaccagatttcggagaagtacaaaagaaatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataacaggaaatgttgttaagttttctgctggaaaagtgaaattaaaattgctgaaggaacagattcaagagccagtgaaaccaaagttaattataaaatggcaaattcttcagaatgtgaaaaacccaagataaatgggaaagttgtggacaggtgagaacaaagctgttctactggtatgccttgaatgtggagaagattatgttcaggatgctttgctaaagttcacaagaa

SEQ ID NO: 61459 - DNA, 340 bp, Homo sapiens
  misc_feature (290)..(290): n is a, c, g, or t
  misc_feature (323)..(323): n is a, c, g, or t
  misc_feature (334)..(334): n is a, c, g, or t
agcggagctatccgcggccatccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaggagaccaaagtacaacacacagctcttttattgccagtagaaacattaaacatagagagacctgaaccatctctanagatagtccgaactgggatggattttggtgctntttcatggatntgtcca

SEQ ID NO: 61460 - DNA, 298 bp, Homo sapiens
tcccttttcctccaggctcagcagtgacatgtctggactgagggcagccacggggctatgtactggtctctgagctgtctaccttacatcaaggtgctcagagctgagagggctggccgcgagtgtaatttgattagagctggattgttcagcattgtaccaatggaagctctatgttaattagtgttctttaagatttacagtacatggcagggtacagtggctcatgcctgcactttgggaggcctaggtgggtggatcacctgaggtcaggagttggagatcagcctgaccaaca

SEQ ID NO: 61461 - DNA, 564 bp, Homo sapiens
gaggctaaggtgagaggaacccttgagcccaggaggtcgaggctgcagtgagctatgatcatgccactgcactccagcctggacaacaaagtgagaccctgtctcaaaaaaaaaaaaaaaaaaaattgtgtgaggggaaataacctaaatgtccaaccatgggagaattagtaaaagaaatcacagtaactgcatgtgactgagtcctgtgttactataagtcacatcttaaaaatgacttactaacaggagcatgtcattaaatgatgtgcaccttaaaaacttagaaatttcagttgtttatttttaaaaacatctacgtagcactatgtgtcaggcactatgcactttgttcatctgaactcatctttttatggcgagagatacaataaaagtcaaaatacaacggtctggaatttcaccatatgaattggtgttaaaatctgataggtaaaaagaactgtagagacagactgtaataggtaagtaggcacaaaagacataaataggctgttcacagaaaaaaggcaataaacattaaaggatgcttaaaagcactgtgag

SEQ ID NO: 61462 - DNA, 870 bp, Homo sapiens
gattaaaaccctttactctggggaggcagccaagagctctgtccacaaaaccaaatctgggtgtcagaggccaagaccccaggttgggatcagggaccaccccctcacggggcataaggtcagttttcccccagagcccgggcccctgtccccctacagtgcaagtgtggtccctggagccccggtgtggagtggtgagtcccggagtagtgcttgtcttggaaagaggggcccttggccagccacccctcagcgacactatacaactcctggagcgcctgccaggattgaagccatgacaaggtgcaggtgggtgccaggcccgctgtgggtgggcactggtcctcagcaccactcaccactgccaggcaggccggggaccagcagactcctcagccaaccctgtcccttggcccggccctgccacagagagggaccccagcccatcatgggcatcggcagggcttggccacttccacctcccgctagaagcctagcgagtgtggatgcatagacatctgagcccagcttcctgcatccccacctggccctcaccacccctcacccccaggcagcgggccagccccgccttcactcccctcccaaccaccccccccaccaccaccaccacccgtaccctcctaggggcttccagagcttttacacctggagaaacattccccactcccctttggcctccctgtaccctgaactgtgaatatttttaacccctaaatatgtaaatacggccagctcttgtgacacagaagctgttttatcaactgtcagtccccattcctttatgataggattctccacagtggtttccgactcaggctccagtggaccaaataaaagtgttttgttaaa

SEQ ID NO: 61463 - DNA, 246 bp, Homo sapiens
tcctcttgaggctcctccatggccctgggccaggcttgcagggaccttctggggcctctcccatcccacagctgctggaaggtctctggtgacaaacggccactgcccactttgggcttccctgctgctgcctcagcctcctctccctgctactcatttccacttttaattcaggtggtcattgaaggctggcattaggcctgccagattctgagggccacctctgacccctcacctgccaacgtg

SEQ ID NO: 61464 - DNA, 651 bp, Homo sapiens
agcacagatggaatcggcttcctgagatccacagaggagaggaaaaacattctgcacttggaccacgcctctttggaaagtgcttccacagatggtatttcctttgaacctggccacagccaaggatgggaaacaggaaggctgagccctgtcagaaaggagttgaacctaaatgccaccaggccatccttccctcctaaggaagctctgaaagtcttacccaagtctgtaactcagactgccccagctcctgcaaaggcagaagttttgttttcacgcatgggagccaaacaaagactcctcccagagtgctccttcctgccaagtctcctgaaggaacagagtgtggtcacgtgcctattgtcagtttccaactgctctctgacttgcacgtgcaccatgtgatgtctgggccaccaggcaggctgcaggtgctccaaaagttctaaggtacttagcaagaagtacaagataagtcaggatccctggtttcaggtcccattctgccctactcatcctgagcatgttactcacctcattgagcaaaagagtaataataatgcctttctcccaggtttgatgatgtgaggatcattttgatatgagggttatcatgtatgcataaacactttgcaaacaactacaagaatt

SEQ ID NO: 61465 - DNA, 1237 bp, Homo sapiens
aggacgtttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaagctggtatctatttaggtattgcagaatgtacatcaatgattggatatgctctgggttatgtgctaggagcaccactagttaaagtccctgagaatactacttctgcaacaaagttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggtagatttaccttcttattgtcatttcaaaaattttgcactgtcttattgtatgtacttatgaaatacttgaaata

SEQ ID NO: 61466 - DNA, 1214 bp, Homo sapiens
aggacgtttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagactggtatctatttaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataa

SEQ ID NO: 61467 - DNA, 448 bp, Homo sapiens
agacaaataacacattattgaaatgccctgataagtgcttttcatagataatactatggaattacagaggaggggcacttaatccagactgggaggggcataaaagaggaatgcactacttcccataacaagaagttctacattgggaccacaccactccaggattgattcattcaatggctcataaatctgccatcctcaggacccagtgatgtccaaggactgaaaaggattgtgtgtctctacttattagcttgagaaaccttgccagaggtccttggacgctttctacctatttgcccaaattagatatatccctggcaaggtgaatgagtgccttagatcagtcccaattcccttctgtaggcctgaagctagagagacttagcaggaagatggaacttacccaaaagtagagctctgccagcatgggaaaaaggaaaagtgc

SEQ ID NO: 61468 - DNA, 301 bp, Homo sapiens
ttccttcacccttaaaggggattatatctacttcattgggtgtatgagaactgatatcctattatgtataaaatgctgaaaacaattcccagcactgaacaaaatttgcaaactaatatatcattgtcatcaacaataacaaaaaataatagcaacatagtatactattatagctcattgcaccatgttcctattttgtgtgttgtctattattttcatcaaaatagaattatcaagttattttaagtcattatttatgcttctgattatttcttggaatattaaaaaacaatttggggga

SEQ ID NO: 61469 - DNA, 385 bp, Homo sapiens
agacttagggtgcctttgagacatttttctttagctggctttttaatgatgcctaattcttatttcataaatgcaagaaccaaaacaaaccactgaacccgattgacactttgcccctgggtggtggtattcaacttgtctgtgtgttttggagggaaaaaaacaagatatcattcataagacatgcttgattcatattttcattaatctctttgtagaacattaaagaaattcccttgtgacgttttggaggacttatttgtgcttgtatgtgcagtcattattgaagtttattttcgtgtttgttttattaagtgaatattcaattctggaggaagttcctgaattaaactgattagaggatttgtttccttaaaacttaatt

SEQ ID NO: 61470 - DNA, 593 bp, Homo sapiens
cagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaaaaaattg

SEQ ID NO: 61471 - DNA, 530 bp, Homo sapiens
gacattcatgcttccataacacactttatcaacctacttaataattctgtgtgtcatgtgtcatggtaagtcacagagatagaatctgtatccatgggatatgtatagacttattggtagcaaagtatgtaataaagggttggttcaattatttgagtctttttcttacccatgtctcttctctgagacaggaaagaaatagtcaatacaactaagtgttccctcactctcctgtgagtgtgactgatatatccatgtgtcttttgtacgttcaatgaattccctgcaggttgtctgggatatctttgtttaattctggagcacatgaagggaacatcaaagtgccatggaagtaaatctaggcccaatctgggtggatgatttcctgtgagttcctctaccagtggaggctgatccaggatattgtgacaacacagtaccctttctagaagaaatttctaccttatcattgataatgaagcctgtatcactctcattttcaaatataaccataaaaaaagttcacaact

SEQ ID NO: 61472 - DNA, 741 bp, Homo sapiens
tcgctctgtcgccaggctggagtacagtggcgcgatctccagtcactgcaatctccgcctcccaggttcaagcaattctcctacctcagcctcccgagtagctgggactacaggcgcgcgccaccacgcccagctaatttttgtatttttagtagagacggggtttcaccatgttggccaggatggtctcagtctcttgacctcgtgatccgtccgcctaggcctccaaaagtgctgggattacaggcgtgagccaccgcgcctggcctacgttaaaattttaatatactcctttgattttgacagtggagaaaactagaatagtaaagttgtcttttcaggaagtggatgatttgggcagtcaaaactgcttttcagagtttcgatgtggtttacaatggtatggacagctggtatgatttgttagttttctacttgtggtgtctttaggttttaaagtttcggagagtcgctgagtgatgtgagtctaaactctagccagtccccgaattgtgagatagttttccttctaaaatatacttcgtacaagctggtcatttttccccttaattcttttgatgttatctgatatactgagaaggttttgtttggtgttcagttttgtgttactgattttgccataaaaactgtttatttacatgatttttagtttttagttcttatagtctttgaattgaataagaaaagtaaatactgaaatgctttgaaagataacaaaat

SEQ ID NO: 61473 - DNA, 2953 bp, Homo sapiens
  misc_feature (2050)..(2050): n is a, c, g, or t
gtatacaacgtgtcagctaaattcagaaattaatctctggggaattattcagtgtttcaacttatacacacacacacacacacacacacacagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaacatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagcggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttcctggtgtctcctctgatcatctcccacgagatcaacgagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggctgtggggaggaaccataaacccagccctcacagctcccagcacagggcctccctgagccagtggcatcctgcctgggccccccatggcagtgctgcctcttgtaggtgctggctaagggccaggccaggatgagtttccccatggtgaatgttaccggatggcatctgttctctccatgccctgggtcacttccttttttgggtctcacagacccctccaggggctgacacctagagagaaccatcaccttgtcccctcattccttccaccctgaggcttgctgtggantcagagaggagacttacctgatgagagctcaaacctctagtctgggatgagctcacagagccctcatgagttaagatccatccatatcacataggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttctagtgctttttggcccaagaatctcagagtgcttctaatcatcacagtagtttttgtgttttgttttgttttgttttgttttgttttgtttttttcacaatctcagccagcctgtggtgtgacctggggagaaagttgagtgtcaggggacatgatgagccagttggccctgaaacaggaatggggcaaagagcaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatagaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctc

SEQ ID NO: 61474 - DNA, 2663 bp, Homo sapiens
  misc_feature (1760)..(1760): n is a, c, g, or t
ggggtgggggtggcttccatcttgtgttctagtgaatcagaacagcccacttcactgatggtgtctttttaactcaaagcatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagcggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttcctggtgtctcctctgatcatctcccacgagatcaacgagaagagccctttctgggagatgtctcaggctcagctgcatcaggaagagtttgaagttgtggtcattctagaagggatggtggaagccacaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggctgtggggaggaaccataaacccagccctcacagctcccagcacagggcctccctgagccagtggcatcctgcctgggccccccatggcagtgctgcctcttgtaggtgctggctaagggccaggccaggatgagtttccccatggtgaatgttaccggatggcatctgttctctccatgccctgggtcacttccttttttgggtctcacagacccctccaggggctgacacctagagagaaccatcaccttgtcccctcattccttccaccctgaggcttgctgtggantcagagaggagacttacctgatgagagctcaaacctctagtctgggatgagctcacagagccctcatgagttaagatccatccatatcacataggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttctagtgctttttggcccaagaatctcagagtgcttctaatcatcacagtagtttttgtgttttgttttgttttgttttgttttgttttgtttttttcacaatctcagccagcctgtggtgtgacctggggagaaagttgagtgtcaggggacatgatgagccagttggccctgaaacaggaatggggcaaagagcaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatagaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctc

SEQ ID NO: 61475 - DNA, 1308 bp, Homo sapiens
aaaaaagccaaacaaggggaaagaaaactgcaacttggccagttaaatcaaatagatacctaaaggtaggggccattgcaaagtatgtaatacagaactgaggaagggtctcagcagaaattcatactttaagggcataaattggcatttaaaaactcaaagattgttcaaataaaaatctgaatttgaaaaaaaacaagcagttttctttattgtaaacaaagcaggcagtcctttactcagcagggtatacactacttgctgcagaagtaatttggaaaaataagatttgggctgaaatctttttcacagcagggtaagctaagttagaaatggccaatgtatgcttttactctggtttggttaataggatcctagtgtaagtattcccaagtttacataagccaggtgactgtagattttccatgtagaaagaacccaagcatattcagtcatggcctctagcgggtagatgggcattgggccattgataacttacatttgatatggatacacattatttgactgagaaactcacaatgcacagactccactcactgaccagccccaccctggccaattctgctaagttcttcagaacagctgagtgacaaaggtcttttctggcgtgagaattgtttacagcaggaagctggagcccaaatctgccctctgtgttaccctctccgctctcctgtttctgtataggtatagctgagaatgctttttacatttttcagtggttggaaaaaaaagaaaaagtatattttgtaacacatgaaaattatatgaatatcaaattttagtgtccataaataaagttttatcagcatagagcaatacccatttgtttccgtattacctatagctgctttagtgctacaatggcagagttagtaattgatacagaggtcaggcatggtggctcacgcctgtaatcccagcactttgggaggccgaggcaggcagatcatctgaggtcaggagttaaagaccagcctggccaacatggcgaaaccccatctctactaaaaatataaaaagctagccaggcgtggtggcaggtgcctataatcccagctacttgggagactgaggcaggagaattgtttgaacccaggaggtgaaggttgcagtgagccaggatcacaccattgcactctagcctgggcgacaagagaaaaactctgtctcaaaaacaacaacaacaaataataataattgggacagagaccatatggtcataaagacaaacatttattctcttccttttcctgaaaatgtttgccaactccaggcttagagcaa

SEQ ID NO: 61476 - DNA, 689 bp, Homo sapiens
tagacctttccacagccgagtcaatttaaatccaccaaacccctttcccagaaggaggtgtaagacccatcagccaatgagaactgcaaacagtctggatagagccatcgctcttgccttgcaggtgcaagcccttagggtgttaagcatgtgctttcctgcatatgatctggctccaggttttaactttacagaatgaggctcgtgcatttcacaatgtttgcctcgagaagccaaatagggaaagtgaacattaaaaaaaattacctaacatctgttgctgaagtctagggagagggcattaaatcccttatgaaacacctgtttggccacatgaaaattgatgtgcttaatagaactcatatcagtctgcacatcttacattggcaattagagtaatgaatgagcctgggctgtggctgcaattgttgatctaattaagttggataaactaatttcagcaggaaggcagagggtaattcatccagagcaactataccactaaacttactgaaaaacccatatatgaagaaggaactggctgcctggtgtggtggcctgtgcctggcctgggtcagcacctgagacagagccccacctgggcttgtttccctctgtgttggaacagaggtgcatgcagcaggggagaaggtgcccaacaaggtgacgggagggcagacaggtccagg

SEQ ID NO: 61477 - DNA, 763 bp, Homo sapiens
atcacagctggatggaactttccagcagcacaggtcaatgttaaattcagcaaaacacctttcccaggaaggaggtgttaagaaccagtcaggggacagaatggatggcccaaggtatgaccctgccacaacacccagaattttcagccaatgagaactgcaaacagtctggatagagccatcgctcttgccttgcaggtgcaagcccttagggtgttaagcatgtgctttcctgcatatgatctggctccaggttttaactttacagaatgaggctcgtgcatttcacaatgtttgcctcgagaagccaaatagggaaagtgaacattaaaaaaaattacctaacatctgttgctgaagtctagggagagggcattaaatcccttatgaaacacctgtttggccacatgaaaattgatgtgcttaatagaactcatatcagtctgcacatcttacattggcaattagagtaatgaatgagcctgggctgtggctgcaattgttgatctaattaagttggataaactaatttcagcaggaaggcagagggtaattcatccagagcaactataccactaaacttactgaaaaacccatatatgaagaaggaactggctgcctggtgtggtggcctgtgcctggcctgggtcagcacctgagacagagccccacctgggcttgtttccctctgtgttggaacagaggtgcatgcagcaggggagaaggtgcccaacaaggtgacgggagggcagacaggtccagg

SEQ ID NO: 61478 - DNA, 292 bp, Homo sapiens
aatttgttcccacagcagagtgggcttcatttagggtaagaagcagtgctttcagtgctttgcagtttgcttagtgattaaactttcttatcttcacatcatcaactaagatgattttattaccaggtcagtcttctttttaaataggcaaaataatttattctctttttacaagggcatactatactaatttctttccacacttaaaagcatagggatgtaaaatctcagttaagagtttcacctaaggtcatttaacagtagaattctatgctgctctcaagtaagacta

SEQ ID NO: 61479 - DNA, 3375 bp, Homo sapiens
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtgggcagcgacagcggagtccggacccagggacagcgctccgggaacctgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcagcttgatgaatgtctgctcttatcgtgagaaagttgaggagtgcagagcttactctcttctctgaattgcctactgttttgggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgcatccctgtgttcaaaaaac

SEQ ID NO: 61480 - DNA, 3056 bp, Homo sapiens
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgcatccctgtgttcaaaaaac

SEQ ID NO: 61481 - DNA, 2324 bp, Homo sapiens
ggggcagctgtgaggcccactgtcgccctaaagtggggttcccacagctctccccgggagtttgcatgcccctggggagttagaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgcatccctgtgttcaaaaaac

SEQ ID NO: 61482 - DNA, 2182 bp, Homo sapiens
  misc_feature (1909)..(1909): n is a, c, g, or t
  misc_feature (1911)..(1911): n is a, c, g, or t
  misc_feature (1920)..(1920): n is a, c, g, or t
  misc_feature (1948)..(1948): n is a, c, g, or t
  misc_feature (1953)..(1955): n is a, c, g, or t
  misc_feature (1957)..(1957): n is a, c, g, or t
  misc_feature (1993)..(1993): n is a, c, g, or t
  misc_feature (2008)..(2008): n is a, c, g, or t
  misc_feature (2017)..(2018): n is a, c, g, or t
  misc_feature (2033)..(2033): n is a, c, g, or t
  misc_feature (2035)..(2036): n is a, c, g, or t
  misc_feature (2040)..(2042): n is a, c, g, or t
  misc_feature (2062)..(2062): n is a, c, g, or t
  misc_feature (2070)..(2070): n is a, c, g, or t
  misc_feature (2075)..(2075): n is a, c, g, or t
  misc_feature (2085)..(2086): n is a, c, g, or t
  misc_feature (2094)..(2095): n is a, c, g, or t
  misc_feature (2099)..(2099): n is a, c, g, or t
  misc_feature (2104)..(2105): n is a, c, g, or t
  misc_feature (2110)..(2110): n is a, c, g, or t
  misc_feature (2114)..(2114): n is a, c, g, or t
  misc_feature (2120)..(2120): n is a, c, g, or t
  misc_feature (2134)..(2134): n is a, c, g, or t
  misc_feature (2141)..(2141): n is a, c, g, or t
  misc_feature (2146)..(2146): n is a, c, g, or t
  misc_feature (2151)..(2151): n is a, c, g, or t
  misc_feature (2156)..(2156): n is a, c, g, or t
  misc_feature (2165)..(2165): n is a, c, g, or t
  misc_feature (2169)..(2169): n is a, c, g, or t
  misc_feature (2173)..(2175): n is a, c, g, or t
  misc_feature (2177)..(2177): n is a, c, g, or t
  misc_feature (2179)..(2179): n is a, c, g, or t
  misc_feature (2182)..(2182): n is a, c, g, or t
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtgggcagcgacagcggagtccggacccagggacagcgctccgggaacctgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttcttttttttttgttaatttgtttattatacacacacttcaagagaatatgcacagtctaggccgggcncngtggctcangcctgtaatcccagcactttgggaggcngaggnnngnggatcacctgaggtcaggagtttgagaccagcctgncacatggtgaaaccntgtctctannaaaaatacaaaattngnngggnnnggtggtgcatgcctgtaatnccagctanttggnaggctgaggnnggagaatnncttnaaccnnggagntggnggttgnagtgagctgagatngcaccantgcantccancctgngcaacagantganactnnntntnaan

SEQ ID NO: 61483 - DNA, 1017 bp, Homo sapiens
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtgggcagcgacagcggagtccggacccagggacagcgctccgggaacctgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtacgtgcgggcgccgcggaggtcagagcgaggcagcggcgccggctcctgaggccggccgcgtatccgatggcctgcgccggggaggtggtggcgcgccccgcgctggctccgtgggcgggggcgtttggcggggtgggccgcggtgaaagcagggtcccagtggtgccgcgcatcccagacgggctctcatgtctggtgccttgtcccaggccagcgcactgcggggttgcagtccgtgcggctcgccaggtgtggggtttcgcaaccgcaaacccaccgagcgccgcgcgccctggggaaggtgcgggacgcgtgcggggccgttgcccagtggcgggggagagcctgggaaacgcccacggtgctccctctcggggaagccaggcgcgagcccacggtaagagctaaacccccctccactggcgcgggtgag

SEQ ID NO: 61484 - DNA, 666 bp, Homo sapiens
aaacaaactcccaaagcccacaaaaggcaatcccagtggacatcatgccccgaacttcatttcctgggctcccttcctcgggttcctggctgtccttccagagaaggcctacaggacacatcccggttccaggggaaagggaggcgtttccgattccctctgagtttgtgttccattgcaggtgttgtgcttcttcctgaaattaacctcacatccttccttgctccctttttcagagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaa

SEQ ID NO: 61485 - DNA, 3294 bp, Homo sapiens
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtgggcagcgacagcggagtccggacccagggacagcgctccgggaacctgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgcatccctgtgttcaaaaaac

SEQ ID NO: 61486 - DNA, 3143 bp, Homo sapiens
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtgggcagcgacagcggagtccggacccagggacagcgctccgggaacctgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccagggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcaatcccgtcctgcagtgatagaaacaggtcgttctgcattataagccataggtggagcattcggtagcgtattcagactgcatgggccggcctaggagtctttgccttcataaattttaagaaccccgcccacaacagggagttaaactggaggactttgcatgattagttcagggatgagtggtttctggggcatctgaggtcaggagttcgaaaccagcctggccaacttgatgaaaccccatctctacccgttctggagaacaggtcacgcctgtcctggagacagtgtgccgggaaaagggaacgtggtactcactggatgcacccaggccggcccgagcctcccaccgcagacagtgtggaacagagtgagcctgagctgcccaaggcgatgccctttgtgctgtatgactggaggcctctccgcgtgggtacttgggggtggggccacaaatctggcgaaaaacttcatgctggccgccgtgaggttttactccagcgttcccgccattgtcatggcgggtcttcgtcctaaactgagaagaaaagcattcctgtttgatcaccgccttagttaccagttctggatcagtcagtgtttctgcatggaataacaaccattaaaaaaagcactgggttctgccctttcatctttgtaagagattcttgcctctagcaatgacaacctgtgatgtctcacagtagagcacttagcgcagaatcaggtccccacggctgttgctcaataaaagtggcggaataaagtgcatccctgtgttcaaaaaac

SEQ ID NO: 61487 - DNA, 2665 bp, Homo sapiens
  misc_feature (2507)..(2507): n is a, c, g, or t
  misc_feature (2511)..(2512): n is a, c, g, or t
  misc_feature (2519)..(2519): n is a, c, g, or t
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtgggcagcgacagcggagtccggacccagggacagcgctccgggaacctgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcactctcaggacagacggcgtggggagcacagaggaggctggcagagctggggactgagggcattgttgctgattctcactcaccggggcagcctgccgcagatgcacaggccccaggtgcaggccaccacctccgggtcggcaccaggactgccctcggtgctcatagggaatggctgggcccacggaaggtcggcctgggatgtggcctgggactgctgctctgctggctgctgtgtggatgcttttcctggagcactttccaaggcatcccccagccccaagcctgcgcgcatctgtcactcagggactttctatgggtctttgtgggggaaggccctggctttgtattccccacaagtagcactgagtttcttaggaaatttgtcttcagtattaggtctccaactcttgtaaaaagtttatatgtaggataaaaaccttttagaggacacgtaggcggtaccactaaggttttggtaatgagccattcaaaccgacagcagtgtgaaggtgtgtcaaggtgtatattctcgtggctcggcattctcagtgcaaaggcctgtttggagactctgtgggaattgtttttcatctgtttctatggttgtcaaatgaattcttcacccaccctacagtttgctaactccttgaagctatcaaattagtaagagaggctgcccgcacccagggggcaccatcgcccacttattatttagttttgcggatactcatggaccatctatcacatccagcattgtcccagtgctttgagttggacgggaatgggactctgcagccaaggcaggataagaaaatcttgcganccgnngggggtnaacacgcggctggttttagccaagtgggcatcggggcgaatctagatggtgggcgcaaggatttgggcaaattaaaacccgccacaggggaacgggggtgggaaacgcgagttgggcatgcacacacaccgaaaaccaacggaaaa

SEQ ID NO: 61488 - DNA, 2235 bp, Homo sapiens
atacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacatgtttacacacggacgcatgttttgcacaggacatatgcacaggatgcatgttttgcacacggacacacacgtttacataggacaagtgcacagggcacgttttgcaccggacgtattctgtgcacgggacgcacggtttgcagatgcaagcacacacactcctcggcgcgacgggcgaagcggggtgggcagcgacagcggagtccggacccagggacagcgctccgggaacctgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtttctgggtggagcggacccctgtgcacgaggcagcccagcggggtgagagcctgcagctgcaacagctgatcgagagcggcgcctgcgtgaaccaggtcaccgtggactccatcacgcccctgcacgcagccagtctgcagggccaggcgcggtgtgtgcagctgctgctggcggctggggcccaggtggatgctcgcaacatcgacggcagcaccccgctctgcgatgcctgcgcctcgggcagcatcgagtgtgtgaagctcttgctgtcctacggggccaaggtcaaccctcccctgtacacagcgtcccccctgcacgaggcctgcatgagcgggagttccgaatgtgtgaggcttcttattgacgtcggggccaatctggaagcgcacgattgccattttgggacccctctgcacgttgcctgtgcccgggagcatctggactgtgtcaaagtgctgctcaatgcaggggccaacgtgaatgcggcaaagcttcatgagactgcccttcaccacgcggccaaggtcaagaatgttgacctcatcgagatgcttatcgagtttggcggcaacatctacgcccgggacaaccgcgggaagaagccgtctgactacacgtggagcagcagcgctcccgccaagtgcttcgagtactacgaaaagacacctctgactctgtcacagctctgcagggtgaacttgaggaaggccactggcgtccgagggctggagaagattgccaagttaaacatcccgccccggctcattgattacctctcctacaactgaattgcaggtggggtccggaccgtgactgcccccgttgtgcccagcattgcccgggtgagggctctgcctgttcctctgaagcagcgtgattgctgtagatagaacaacgctccttcgagtcccttcctgcgatcctgtttaggcttctctcctggatcctggataatgtttccagggtgttgggaaggcctgcgtctcaggtcacagttgtgggtgtggccctgcgctgttctacagaacctaccctctcaatgggcatgggcccaaccatccagttttcctcttttacggaccatcctcaaaggcacttcttttcttatggggcagaaacaccaagatgggcgcatcctgtgtggatggagaggggtggctctcgtcttgctgtgtcccaggtcgtttggcagcgctgtgcttgccagggagccacactttcccatctcttccccaggtctcctgatgccaacttcagcaccccccttatgtggacttttcttgggggagacagacgctgtccacgggaccaggtgactgggattttgggtcctcccctgcccttatgcagggctgtgactgcacacaggtttatctgcttctctactctgagttgttccggaaagctgcaaaaccgagataatggatcagacttggagcattgaaggggtcttgatgaccaaccactgagccaagcccgtcacctcaggtggacgagattgggtccccagcgtcaggttttgtgttttttttttttttttttgaggtggagttgcactccagcctgggagacagagtgagactctgtccccacaaaaaagaaaaaaaaaagatgccttgaaaagcctaaagtggtccccaaatatgaa

SEQ ID NO: 61489 - DNA, 806 bp, Homo sapiens
agcatggagctccctaagcacaaggaggcggtgacgtgtcttgcagagaaaatgcatgtgtgagatgagcttggttcaggccgcagtgacagtgctggcggccgtgggtttcgtgttaatgaatcaatcatacgtagtcaataaggtgtctgtgaacagagcacgcggagaacaaggttatgcactgatgggtggatgacaacgtcagggccagaggctcccaggaccctgagccggcgtgtcccctaggagcagtggttccatatccgctaattcagcacgtgcagtaaatgtatagaatatgacttcaccagtatcgagactgactgatttctcacgttcccgtggcctcctgttagaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctttttttgaggtaaaattttgcaattactctttcatttataaattaaactgttaagacaacaataaattatagatacactttctactagcctttaaaactattgtttttagatttgggattactttaatctatagtgattctagatcgcgagc

SEQ ID NO: 61490 - DNA, 722 bp, Homo sapiens
tttttccaggtgtttgttcttttattccttaccgaggtaaaacacacgtacagacaaacgcacaaattccagtgatttcccacaaattgaacacacacatgtaactagcacccagatgaggaaacagagcatgaccaggacttccccttccaaaatatacctccctttgtgccacctgtcaggcactaccgcagacctggggccactctgctgtcacccagcagcttggtgactttgcttttggtgaaaggtcccgtgcgtgtgtctgaatgagtgactcagtctgtatcgggcttgactcagtgcagctctcccataccaagtctaattagctactggctctaagttggtataatgcttgtgatctgttttagggaatgtcatacatgagtgtttattgttttgaataaatccaagaggtcagtgtaggccaaggttctcatctgatgcaggagccaacccagccatattttctagaacccactgcaagcttagaggctgttttcgagagcagtagtgagatgggtcttgtgttttgaatgcgtgtgtgtgcgttcctcattacttctggtccgggttatctctgatctatgctggtggaaaggagggaggagggagggggccccatggcacagggggtagaggacagagccatgccctgtgccttgattccctggttcccgttcagcccccttcctctgatggtgcatggaccaacagcc

SEQ ID NO: 61491 - DNA, 938 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctggtgagctggggcaccgggggccaggggtggtagggggcagctctttgtgcctctccaggtgagccaagggaccagggggctggaggtggtgggggggcagctctctgttcctctcctggtgagccgggggaccaggcgctgggggcagtaggaggggcagttctctgtgcctcttaggctgttgcttaaggctgggggcagtgggcagggggtgtggcagcgggcgc

SEQ ID NO: 61492 - DNA, 593 bp, Homo sapiens
tgaatcctacctgccgtccatgggaacactgcccctcacccggggccctgccttccacatgccagcagggtgcgtgcctgcagcccatctgcctcttcattccagagcccgctctgcctctgtctctggtgaatccacgtgttctctgagtgtgacattcctaacttttcttttctgcctctgcaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggtgggagacgcgggtcccctctgccctttgctgtggctgcctcaggggcctctcgccacctgtgggtcctgtggcagtcctcagctgtgagtgctcgggctcgggtctgagtgtcttaagcagagtaagtttgtcggacaccatcttgacagaagcattgaagatgtggtctgtgtgacccagcgagaggcctcacggtgctacggaagagcatgatgagaaaacgcagggcggtc

SEQ ID NO: 61493 - DNA, 5493 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61494 - DNA, 5444 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61495 - DNA, 4878 bp, Homo sapiens
acgctggggagattccagtgtgattagaaacgctaacgatgacaactgcgttctcatctttattttgcggtttgagttttgtgtttcgaatttcagtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61496 - DNA, 5420 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61497 - DNA, 3994 bp, Homo sapiens
ggcttcatcctgcctagcaggtacatcttggcttaggctattagcttcatcctcaaataaagcctcagtacccgatacctcagtagtattactagttgtagcaaaccaaattgttcagtgaatgctagctgctattctccttggggtaccatggaagcaaagtgagggttctctcatgcctcccaggggggtgggtgtgtggagctttctggagggagcacacccattctcattttattttgcatccagagaaacattgtcctgacaagatgatgtgacagggacacgtgttcatttggaaggtctgtgctaatggtctccttttccccctgaatgttttagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61498 - DNA, 2890 bp, Homo sapiens
ctagattgtcggaaggatgtcatgcgaaccgttacacacatttttcgttctcggagtgctcgcagcgtttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61499 - DNA, 5411 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61500 - DNA, 5877 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaaaaaaaaaaatccggctccttacttcatccaacagtgacggggggaaggtcttgaaaatgacccgggaccattctgaacgtgctccttcctcactctaggcaccggtcacgttaccttaatgcagactcttcatgtcttttctccatggtgataatttcaagatcttacttgacagtgattgattgattgcgttttaggaaatggtcactcatataaaagagaaaacaggtgaacagaggtgctaaccagggagtaaatgtgctgggcaggcctgggttccatgtttattctgtgttatgcaaacagaatcctggccagtggagtttattgaaatggaaagggcactttgatgccttcgattttttcccctgtgctttggagaga

SEQ ID NO: 61501 - DNA, 4117 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61502 - DNA, 2680 bp, Homo sapiens
agcatggagctccctaagcacaaggaggcggtgacgtgtcttgcagagaaaatgcatgtgtgagatgagcttggttcaggccgcagtgacagtgctggcggccgtgggtttcgtgttaatgaatcaatcatacgtagtcaataaggtgtctgtgaacagagcacgcggagaacaaggttatgcactgatgggtggatgacaacgtcagggccagaggctcccaggaccctgagccggcgtgtcccctaggagcagtggttccatatccgctaattcagcacgtgcagtaaatgtatagaatatgacttcaccagtatcgagactgactgatttctcacgttcccgtggcctcctgttagaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61503 - DNA, 2475 bp, Homo sapiens
agaagcatatatcatagttagtaggaggagggtgatcggttaaggttgcatatgcaattcttagagcaaccagtgaaaaataaaacaaaaatataatgcttaaaaacagtaaagaagcttacaacagtatcaagtgtggtactcccaataatacattctttaagatttttgcttaagcagtcaatgatctttcaagaaagttaagaaaaattaagaaactgcccatatatttacgttttctggtgagcctcatttcttcttaaagacccagggttctagcttgcattttttcccagtagacctcacctgtgcattcctcaggcgccaggtggcacgtggtgatcccccccatcaccacgctggaaagagcagtgaggccggctctggtgctggcgtcttatgttgccaatgacactgcctggccccatcctagctccttccttccacaggcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 61504 - DNA, 5089 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtagggtggagggcccgccatccccagcatccccggcaggtctcgcttgccctggccgcatccccatgctcccgagagccagccacacgcccttgtgccctcctgccttcgcctctcagggctcccctcctaacaggcacgtgcagggttggtgccaacgggcccacaggtcaccatgtgctggtttcatggtgtggtccaagcactccacagcgcattcccccaaactggatggcttcaaatgacagaacttaattttctcacagttctcgacgctggaggtccaaaaccaaggtgtcggcagagccgcttccctcgggggctcggggggagcgtgcactccaggcccttctctcccccacccgctcatgtggccgccgtccttggcgtgccctggctgtggacgtggcactctaacctgtgcctgcaccacatggcactctctctccctgtgtgtgtctcttatggggatgctggtcgtactggattaaccagtgtgaccacatctgaactatctgcagactctacttccaaagaagctcacattctgaggttcagaggatatggatttggggggacactgttcaacccattacagtctgccctctggccccctaaatccacatctgttccacatgcaaaatacaccccctccatcactacatcccccgaagtcccagtccctccagtgtcagttctgagccccaaatctccaagtgaagccaaagccctccgatgtgggtgagccgtgggcgggtcccacctggggcagaaccaacccctcttgcaccgtgaacctgcgcagctagaacaggctgtctcttcccaaaacacaaggctgggccaggcagaggttagacattctcatccgaaaagggagaaattggaaggaaagctggacttccaggccccgagcaagtcggagacacggcgggggtggggcggaattcgtttagtgttttcccccataacttaattggggtataattgatgaataaaaattatatatatctaaggtatacaaggtgatatttcagtatacattgtgaaataatcacaagctaattaccatatctgtcacctcacacaggtggctgttgtttggtgagaacacttaagatgcaccccagcacttttccagcacgcagtgcagtcttcttccccagaggcccctcggccattaggttctaagcccgagaagggtcctgtgcaggacgcagcgaggtttacatctggagcctgaaggccctggcccagcccccgcagagggtgcccctcgaggactgctctgagatcaactgcatgatccgggtgaagaagcaggtagggtggagggcccgcatccccagcatccccggcaggtct

SEQ ID NO: 61505 - DNA, 4849 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtagggtggagggcccgccatccccagcatccccggcaggtctcgcttgccctggccgcatccccatgctcccgagagccagccacacgcccttgtgccctcctgccttcgcctctcagggctcccctcctaacaggcacgtgcagggttggtgccaacgggcccacaggtcaccatgtgctggtttcatggtgtggtccaagcactccacagcgcattcccccaaactggatggcttcaaatgacagaacttaattttctcacagttctcgacgctggaggtccaaaaccaaggtgtcggcagagccgcttccctcgggggctcggggggagcgtgcactccaggcccttctctcccccacccgctcatgtggccgccgtccttggcgtgccctggctgtggacgtggcactctaacctgtgcctgcaccacatggcactctctctccctgtgtgtgtctcttatggggatgctggtcgtactggattaaccagtgtgaccacatctgaactatctgcagaagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaaaaaaaaaaatccggctccttacttcatccaacagtgacggggggaaggtcttgaaaatgacccgggaccattctgaacgtgctccttcctcactctaggcaccggtcacgttaccttaatgcagactcttcatgtcttttctccatggtgataatttcaagatcttacttgacagtgattgattgattgcgttttaggaaatggtcactcatataaaagagaaaacaggtgaacagaggtgctaaccagggagtaaatgtgctgggcaggcctgggttccatgtttattctgtgttatgcaaacagaatcctggccagtggagtttattgaaatggaaagggcactttgatgccttcgattttttcccctgtgctttggagaga

SEQ ID NO: 61506 - DNA, 4372 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtagggtggagggcccgccatccccagcatccccggcgggtcccacctggggcagaaccaacccctcttgcaccgtgaacctgcgcagctagaacaggctgtctcttcccaaaacacaaggctgggccaggcagaggttagacattctcatccgaaaagggagaaattggaaggaaagctggacttccaggccccgagcaagtcggagacacggcgggggtggggcggaattcgtttagtgttttcccccataacttaattggggtataattgatgaataaaaattatatatatctaaggtatacaaggtgatatttcagtatacattgtgaaataatcacaagctaattaccatatctgtcacctcacacaggtggctgttgtttggtgagaacacttaagatgcaccccagcacttttccagcacgcagtgcagtcttcttccccagaggcccctcggccattaggttctaagcccgagaagggtcctgtgcaggacgcagcgaggtttacatctggagcctgaaggccctggcccagcccccgcagagggtgcccctcgaggactgctctgagatcaactgcatgatccgggtgaagaagcaggtagggtggagggcccgcatccccagcatccccggcaggtct

SEQ ID NO: 61507 - DNA, 3351 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtggtgagtacacgaagcgtcaggaaagaagcctctgaattcacgtgatttctgaaacccaagtgtgttcatccatattcgacagtaggatacaagctattccacagcctcactcggtttctgtaaacagggggtcttaactttcacctggagttttcaaattaaatgtaagcttgttccca

SEQ ID NO: 61508 - DNA, 3030 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggtgggagacgcgggtcccctctgccctttgctgtggctgcctcaggggcctctcgccacctgtgggtcctgtggcagtcctcagctgtgagtgctcgggctcgggtctgagtgtcttaagcagagtaagtttgtcggacaccatcttgacagaagcattgaagatgtggtctgtgtgacccagcgagaggcctcacggtgctacggaagagcatgatgagaaaacgcagggcggtc

SEQ ID NO: 61509 - DNA, 2816 bp, Homo sapiens
aggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaacggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggtaaggacagcacaggcagacggcgccagaccccacctgtgtttaggagacagatggctggagtgggccctgagcagtctgccagccatgccaagtaccagctgcagcccttctgcagaccgaatgccttcctgtccctcagtttgctcatctgtaaagcaggaataaggctgataccttctcagtgggtggt

SEQ ID NO: 61510 - DNA, 1646 bp, Homo sapiens
aagcttgcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtagggtggagggcccgccatccccagcatccccggcaggtctcgcttgccctggccgcatccccatgctcccgagagccagccacacgcccttgtgccctcctgccttcgcctctcagggctcccctcctaacaggcacgtgcagggttggtgccaacgggcccacaggtcaccatgtgctggtttcatggtgtggtccaagcactccacagcgcattcccccaaactggatggcttcaaatgacagaacttaattttctcacagttctcgacgctggaggtccaaaaccaaggtgtcggcagagccgcttccctcgggggctcggggggagcgtgcactccaggcccttctctcccccacccgctcatgtggccgccgtccttggcgtgccctggctgtggacgtggcactctaacctgtgcctgcaccacatggcactctctctccctgtgtgtgtctcttatggggatgctggtcgtactggattaaccagtgtgaccacatctgaactatctgcagactctacttccaaagaagctcacattctgaggttcagaggatatggatttggggggacactgttcaacccattacagtctgccctctggccccctaaatccacatctgttccacatgcaaaatacaccccctccatcactacatcccccgaagtcccagtccctccagtgtcagttctgagccccaaatctccaagtgaagccaaagccctccgatgtgggtgagccgtgggcgggtcccacctggggcagaaccaacccctcttgcaccgtgaacctgcgcagctagaacaggctgtctcttcccaaaacacaaggctgggccaggcagaggttagacattctcatccgaaaagggagaaattggaaggaaagctggacttccaggccccgagcaagtcggagacacggcgggggtggggcggaattcgtttagtgttttcccccataacttaattggggtataattgatgaataaaaattatatatatctaaggtatacaaggtgatatttcagtatacattgtgaaataatcacaagctaattaccatatctgtcacctcacacaggtggctgttgtttggtgagaacacttaagatgcaccccagcacttttccagcacgcagtgcagtcttcttccccagaggcccctcggccattaggttctaagcccgagaagggtcctgtgcaggacgcagcgaggtttacatctggagcctgaaggccctggcccagcccccgcagagggtgcccctcgaggactgctctgagatcaactgcatgatccgggtgaagaagcaggtagggtggagggcccgcatccccagcatccccggcaggtct

SEQ ID NO: 61511 - DNA, 433 bp, Homo sapiens
ggacttccccttccaaaatatacctccctttgtgccacctgtcaggcactaccgcagacctggggccactctgctgtcacccagcagcttggtgactttgcttttggtgaaaggtcctggagctgctgctgcagacgctggggagattccagtgtgattagaaacgctaacgatgacaactgcgttctcatctttattttgcggtttgagttttgtgtttcgaatttcagtttattggctcttctgaagccctgtaaagattttgaagtggacagtcatataaaagatttcgctgcgaagctgtctttaatacccagcccgccacctggaccgctccatttggtaaagtatatctgaaattatattgttttttctttgcaatagtaaaagtaagatgttgaagataatgtaaatgctcacaactatttctgaa

SEQ ID NO: 61512 - DNA, 469 bp, Homo sapiens
tgtgtgaacggggaccgctgacgaggttccatttcagttcatggtcatgtcatggctctatgacaacacctcattgagcctgcggcccgcggtggtgggagaggtgggcgtcccgagaaacccgccttttcctgccgagtcagttacatttgagccaagcctggctgtggctgcattcatagcatgtttgcatgttattatcatgtttgcaggttacgtttgcaggttattatgtttgcatgttattatcatgtttgcaggttatccgtgttgagcacattttctctcatggcgacttggttctctcttgggttaaaatgtgcacagtgttttcaggggcccaagttaaaggtgtgtgtgtgtgttttgtgccccccaacgtgtactcgtgcagcatggacggcatggtgctggtgtggaatgtgagcacactgcaggtgaccagccgcttccagctgccgcgaggtgg

SEQ ID NO: 61513 - DNA, 867 bp, Homo sapiens
  misc_feature (106)..(106): n is a, c, g, or t
cacgattctaccaggccctccagctgcgtggtctccgcagaccaggctctgtgtgggctagaggaatgtcgcccattactcctcaggcctggccctcgggcctccntgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgtttgttgtcaaaaaacagaaacggtagacaaaaaggggggcggggtaaagatcaccccgggggtcagacgtagcgagaccgttttggcaagggcccaaggggggataagagaaggcgggcggtaacatggcgggaacggtcggcttgggggccacttgggg

SEQ ID NO: 61514 - DNA, 343 bp, Homo sapiens
ccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaaaaaaaaaaagaaaaaaaaaattatgaaag

SEQ ID NO: 61515 - DNA, 708 bp, Homo sapiens
  misc_feature (106)..(106): n is a, c, g, or t
cacgattctaccaggccctccagctgcgtggtctccgcagaccaggctctgtgtgggctagaggaatgtcgcccattactcctcaggcctggccctcgggcctccntgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgtt

SEQ ID NO: 61516 - DNA, 560 bp, Homo sapiens
ccctgaaaaggaaaaagaagaaatagagaaaagttgaaggatatgtacaaattcactcaggtcatatgtactggagtcacaattcaaacctagatgtaagttttccagagtcagggtgcttgtggtatgcttaatacaagcttttaaaagtgtcatggttaggtcccacagctagactacctgagttcaaatcctaactgccctcagtagtcacgtgttcttgggtaacgttcttaacttttctgtatctcagtttcctcatctctaaaatagtaggaatattaatagtctacacctcataagattgttgtgaagattaaacgagttaataaagtgctgtgaatgatgcctggcacaaagaaggcactcaataaatagtagttcttatagttgttgtatatgctttatttgttactcgttttcatagcaggattgtaactacttgtttcagggccaagataccagtttctttttatccctagagcctaaaatggcatcattcactaaaataaaattgtgtttaaaaataaagatatatacttaattctaaaaaaaaatca

SEQ ID NO: 61517 - DNA, 433 bp, Homo sapiens
aggatcactgttgttgctaattttttttcttttaaaaaatacagatatttttaataaaagtatgttaattatgttaacctgtaatgggcttattatttcaaaatcaattaacaatgtaaatatttaaaacttctgtgttaaaatttctaatagtataaatagcagtagatttagcccactctaagggagatggttgtgctttagtcaggagtaggccgaggcagccttctggtgcagcatgactcagtgggtttggaggcaggcacacaactccacacattatgtaaccatgccatgtgaggtgcattaggtgaccactcatatgagcacgtgcttggctcaaagccactattgtctgtaaaaggtaaaattaccctgctgacactacatatggcttgcacccagagagagaataaagccatgtcgaaaccgc

SEQ ID NO: 61518 - DNA, 157 bp, Homo sapiens
acatttaactacataaacaaaaaatatggcattgaattacaaaacaaccagataagtataggatggtatgaacttgccttgacaggcccaaaaaaaaaaaaaaaaaaaaaaaattgtggtcctctcagctggatcattagcttactatgaggcaaag

SEQ ID NO: 61519 - DNA, 476 bp, Homo sapiens
cagacagcatagtaagtagaaaatggaaatgagattttactaaacccttctccttcctcacttcgaaggccttctgggaaagacagcaaagttgagctcatataaaccaaaagctctggccccagctctacctgcatggtggggggaatggcccattcttccttacttctgacaactggctcttcaaatacacttcaaatacctgggaacctattcatatccatcctctgaatgggaagaaaattgcttctccttggcaaacagctttggcctgggcaatggtcccaatctgtcattagtatgagaaactttccagtattttcatttttgtggtcactgttctcttctatttccttttatgtattagttcataagcactatgtttcaaaaggactaagacattctagagtccttgattgttcactcatctttccattcattttttaaataaacatttattaagttcctttatatgt

SEQ ID NO: 61520 - DNA, 401 bp, Homo sapiens
ttaaacgtcagggagttttagaaactgttattgttgtgtggacagttgagcacaacagaggggaaaagactagactcgctggctcacaaaaacaagacaatgctccatattgcacgtaatcatcgagcctgcccacgggactatccaggaagattgctcagtgacaaatcgatgctggagcagcttttgttctaaaacagagcaaaaggaaaacttggcaacaaaacagacactggcaggttactctatcacaatagacagtctgcagttatattttttgctgagcaatttttacaatatgacatattcattttacagttttgattttatttttcagagagatgtagtccttgtaaatgctgggtgcgattttcacttggtttatgttaaatccagtgtga

SEQ ID NO: 61521 - DNA, 218 bp, Homo sapiens
tcagctgtgtgcctcactatgctaggccgccccgctgaggttgttggaggccttattgtggctccatggtgacctcttggttcagagcttgcttgacctccagccctctccgtggatggctccttcctgccctcacaggcaccgtcctggccccggctccagttatgtccatgcctcggccctctgcagcttcctcccattccatgtgtcccagggcc

SEQ ID NO: 61522 - DNA, 677 bp, Homo sapiens
ggtaccggtccggcagttcccgggatatcgttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61523 - DNA, 2517 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgcccctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61524 - DNA, 2036 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61525 - DNA, 1920 bp, Homo sapiens
cttttggaagtaaaggctttgtaagggagccagacttgacttttaccaaaaccacatcttaacatttttttggctaagtacagaaaaattatatgtatatttacagaacttacatttgtggaatatgtcttttattcttttatcagccaaaactatcctgaggtctgtgttttgtatttgaggaattttgggttttaatttcttaaaatctcttgaattctagtgagttagagattccatagggttgtactgttttccagtctaggaaatgatttaaaatagctgcctggtgctaatgttggaatgttcctagaaagtaaatatgtttccttgcatcttaagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61526 - DNA, 2568 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61527 - DNA, 929 bp, Homo sapiens
acgcttgattgcccatggtagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61528 - DNA, 956 bp, Homo sapiens
atttggtgattttaagtgtgttttttaacttaaactactattgtttttaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61529 - DNA, 1466 bp, Homo sapiens
taagttatcaaaagaggttattgaacaatggttttcaaattgagctgcacattagaattactttaaaattatatatagatagctaccctttcccagtaaaatgagaaattcttatttgattgatcaagggacctagatcagaatttgttttaaactcctcaggatctgaatgtgtagccagagttgacaattactgttctggaatttgttggggggtattctagaaagaagtccataaaagaaggttagaggccagatacggtggctcacgcctgtaatcccagcactttgggaggccaagggcaggtggatcacttgaggccaggagttcaagaccagcctggctaacgtggtggtgatgcacacctgtagtcgcagctgctcgggaggctgaggcatgagaatcgcttgaacccaggaggtagaggttgcagtgagccaagattgcaccactgcactccagcctgggcaacagagtgagactctatctcaaacaaacaaagaaaaagaaaaaaagaaaaggttagaaaagatgagagatgataaagggtccatttgaggttaggtaatatggtttggtatccctgtagttaaaagtttttgtcttattttagaatactgtgatctatttctttagtattaatttttccttctgttttcctcatcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61530 - DNA, 1019 bp, Homo sapiens
ctcccttccaccgcctcccttccccagcactagttctctgtctctcccttccaccgctcccttccaccagcctcccttccagcagctcccttccaccagcctcccttccaccagcctcccttccaccagcctcccttccaccagcctcccttccaccagcctcccttccaccagcctcccttccaccagcctcccttccaccagctcccttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61531 - DNA, 2409 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggtaaggaacttaagggtcaccctaccttatggtccactttttgcctctcaccctttttattgaaataaaaataaatagcattttaaaaagaactttattttcttggtcatttctttgaacacctaggtatagaagtagtaatagatcatatttctacctcatcgcagaaaatgttgctcaagtactcttagtttatttattattattactttaaatgctgaactgcatcaggatggattagttcctttgagattttaagtgttttggtgatttaatatattgtaaaatgccaaactggctgaaagagactttacatattatttatttatttatttatttatttatttatttatctatttatatgtgagacagagtcgtcaggcctgttgcccaggctagagtgcagtggtgtgattctcggctcactgcaaccttcacctcctggtttcaagcgatttgcctacctcagcctcctgagtaactgggattacaggcgtgtgtcaccacacccggctaattttgtttttagtagagaagaggtttcaccatgttggccaggctggtctcaaactcctgactgcaagtgacccacccgcctcagcctcccaaagtgctgttgggttacagacatgagcctctgtgcccagcccttgtttttttgtttttttttttttttccttttttgaaacgagtctcactccgtcacccaggctggagtgcagtgcagtggcacgatctcagctcactgcaaccactgcctcctgagttcaagcgattctcctgtcacagcctcccaagttgctgggactacaggcgcatgccatcaagcccagctaagtttgtatttttagtagaggctcccccatgaagctgtcc

SEQ ID NO: 61532 - DNA, 519 bp, Homo sapiens
gtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattgatatactgtcctttttaacgctttaaaaacagattttgaggggagaaaagtattgtttcagttttgcttttgataaaaatataatttgacttctttg

SEQ ID NO: 61533 - DNA, 2890 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 61534 - DNA, 3629 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattgaaaacacaaaaaaaaaaaaaaaaaaaaaaaaaaaaaaaaaaaaaaaacaaaaaacacacacaacacaacaaacaaaaaaaaaaaaaaaaaaaaaaaaaaaaaataaaactacgcggcgcactacacctatacattcactcttccacatagcccaacaaaaataaacatctaaccactattgtcataacaaacaatgctctacataataaggcggggactgtatatatataataacaagaacgactgggtgcgctatattttctataacacgaggtgtggtctggtataacaatctcggatcaaatcgtatactcttttatgcagaggacgcaccttattttctgtgggagtgccatccaaaacaataaggagcagacaacactacatcaacaaacgtatacccacacccgacagcggcaacatctatcaacctctcataagcagataactatactcgtgctacaacaacaagagaaatataagccggcagcacgcaaaaaaaagtttgcaccacgctagtaagataactaaaaaaagaaaaaataaacggaggaggcacaacaaatacaactaatagccagcgcgcccacgtcaacaaacacaagataccgaaaccagatacccaacgtcctaagatcacagcaagcggcagtgcatgagccccagcgcagccagcataagttcagcagcagtgtacacgtcctagcatcacttctcacgaaaaaacatcacacaacccc

SEQ ID NO: 61535 - DNA, 2582 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtttgttgaggtagcactggtaccggagctcga

SEQ ID NO: 61536 - DNA, 2412 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatccttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttctccgcgtcgtctgtttatcctcaagagt

SEQ ID NO: 61537 - DNA, 1270 bp, Homo sapiens
gctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggtaactatatataattttgctttgtaaaggaatggaggggttctagaatgactttgtcatagctaaacatgtaattatattttatttatgatttctttgccacaaaaatatatcagataaagaaataataaggtttggggatggggagaaattttgcaggtagattattcaagctactgctgctaaaagaccgcatttgagaactcaagctgttaccgtaaacagatatgatttcacttcatcttacttattttt

SEQ ID NO: 61538 - DNA, 392 bp, Homo sapiens
aagttgtggcactcagtgcacatatatgctttttctagaaaggatgagaagacctggatttatcactgggacaagctagagaaggctcagcaaatgctgagctcctgttcaggacaccaggtctattttttgtctgcacatttagtgccctaatgcaggttaatgagaagccaggcagtcaagtcaccactggaagagtgcactgtcaatcccttctggggagaagcatgaaactgcttttttagccccttctctgtactgctcatgggagtgcttgtgcacccatttaaaaccaccccttcattttgtgatctggggagacttgcacattcccagtcttctctacttccagagcttagaggtttaagatatagtcctttgggtgtaagctg

SEQ ID NO: 61539 - DNA, 442 bp, Homo sapiens
ccatgggtctttttgaaactgttttcagtagatgtatgggggtttctcagtatatgtctatttattttaacatgccagaatctattttaataaaaactatacaatgaaaagctatacacagtaaatatatacgcaaataaaaactggttatacaagtctcacaaaggaaatagctttatcactttactcatacctgtttgctttattttgatttgttttgttttaagaagccagtacagacaggcacagtggctcatgcctgtaatcacagcattttgggaaggctgggatgggaggatcacttgagcccaagagtttaagactagcctgggcaacatagggacaccccatctctagaagaaaaaaaaaattagccaggcatggtggtacacacctgtggtcccagcctcaggaggctcaggtgggaggattgcttgagcct

SEQ ID NO: 61540 - DNA, 503 bp, Homo sapiens
attatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacagtcttggctcatggcaaactctgcctcgcaagcagctgggactacaggcatgctccacggtgcccagttaattttttttgtattcttagtggagacagggtttcaccatgttggccagg

SEQ ID NO: 61541 - DNA, 807 bp, Homo sapiens
gattgatccacatggacatggagagatgaccaggaaacagttacatttaagcaaatttccatgtgcgttttagtatgtgatgatccattttgtagaataaaattatatatccatcacagggcaaatgtgatattgttattaaaagaaattaggtgcttcacaaatcttaaacattacagcattctcaggtcattaagttattataatattctatctaattaacataaaaaattcaatttaaaacccagaagaagaacatcattcagggtcaaggtttgtttgttggatgagaagaaatatacattcgttataaccgtgttttgttttcaataaatatgaaaaagtattcctttcaaaacattacactctggattggtgatgttcttttcccaatgagcatacctttgtaaaataaaatttactttactttgtctattacttggtatctctctgtctcttttacttttgattgtggagaatttcaaacatgcagggaagtcagcagcccagtaaaatgaatgccctcgtggcctatggtctcaataaccatcaacccttggccagtcttgccctatccacacctagattcccttccccagcccctgttcctacgtgagtttgaagcaaatcccaggcatcatttaaacacctccatttagctgggtgccatgactcatgcctgtaatcccaaccctttgggagactgaggtgggagggtcatttgaaggagtttgagaccagcctggggcaacacagtgaggacctcatctctacaaaaaattttttttaaaaacttaggctggacgt

SEQ ID NO: 61542 - DNA, 227 bp, Homo sapiens
gagaaaccctgttgaagtatcaggtaaatggtgtgacaaaattagaatcctgtcaaatcacctatccagccatcggggtcccttccttttttagactaatttctaaggtaaccagaatctaatgtatctatgttagggtctcagtaaagcaaagacgtttgtcagggcgtagactcttgagttaaattttttaatcattttttaaagcaaggcggttcttagaaagt

SEQ ID NO: 61543 - DNA, 396 bp, Homo sapiens
gagcttttaaggaaaaaattacttagtttttctagtcaaatctcaatacttgtaggataaagtccaagtctcttagctagtactgatagaattcattattcatacaataagtattttaagacattcctggccgggcatggtggctcatgcctgtaatcccagcacttagagaggctgaggcaggcagatcacttgagctcaggagttcaagaggagctggggcagcatggcgaaaccttgtctctactaaaaatacaaaagctagctgggcatggtgatgtgcacctgtagtcccagctagtcaggaggctgagatgggaggattgcttgagtcctggaggacagaactgcagtgagctgtgattacaccactgcattccagcctgggtgacagag

SEQ ID NO: 61544 - DNA, 593 bp, Homo sapiens
ccctaccccagaccactggtcctgcctcaagtgatggacataaccctctcctaggacatacatgtaaatgcacaatgtgactcattctcatacttttttgttcagctctgagccctcaaaagtgatttgtcagcagcgctggcattgcagctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgaggccacaggcaggagtggtgtgggcacactgcttaggagtcaacatcttcatcattgggctttctttaaaacgtgcactttgtaatttgaaagagaattattaaagcatactgaaaaaaggaaatttacaatttcccagccctcacaattaa

SEQ ID NO: 61545 - DNA, 555 bp, Homo sapiens
ccctaccccagaccactggtcctgcctcaagtgatggacataaccctctcctaggacatacatgtaaatgcacaatgtgactcattctcatacttttttgttcagctctgagccctcaaaagtgatttgtcagcagcgctggcattgcagctttgcctggctgctatctctagaggcaagtctgccacgagagggcactgcaggcgaagcagttgtgcttgctcattgcctcagcccaagtgtactcaaagaaaagaggcagccagctgtgcgtgctgtacggaaagcctcccgccctccctgcagctccccgccctcagtggcccagggctttgttgaagtggaactccccacttccaacctggtatggctccttctgcgaagggaagctgatcccagcctcctgagctgaatccttcaaaggcacagcaggcagaatgaggccacaggcaggagtggtgtgggcacactgcttaggagtcaacatcttcatcattgggctttctttaaaacgtgcactttgtaatttgaaagagaattattaaagcatactga

SEQ ID NO: 61546 - DNA, 2972 bp, Homo sapiens
ccccacccgaaacacactcagcccttgcactgacctgccttctgattggaggctggttgcttcggataatgacctccaggaccccactgttggttacagcctgtttgtattattcttactgcaactcaagacacctgcagcagggcgtgagaaaaagtaaaagaccagtattttcacattgccaggtaccagaaacacagaagactgacacccgccacttaagtggggccagggctggtgtctgcccatgttgccatcctgatgggctgcttgccacaatgagggatcttcttcaatacatcgcttgcttctttgcctttttctctgctgggtttttgattgtggccacctggactgactgttggatggtgaatgctgatgactctctggaggtgagcacaaaatgccgaggcctctggtgggaatgcgtcacaaatgcttttgatgggattcgcacctgtgatgagtacgattccatacttgcggagcatcccttgaagctggtggtaactcgagcgttgatgattactgcagatattctagctgggtttggatttctcaccctgctccttggtcttgactgcgtgaaattcctccctgatgagccgtacattaaagtccgcatctgctttgttgctggagccacgttactaatagcaggtaccccaggaatcattggctctgtgtggtatgctgttgatgtgtatgtggaacgttctactttggttttgcacaatatatttcttggtatccaatataaatttggttggtcctgttggctcggaatggctgggtctctgggttgctttttggctggagctgttctcacctgctgcttatatctttttaaagatgttggacctgagagaaactatccttattccttgaggaaagcctattcagccgcgggtgtttccatggccaagtcatactcagcccctcgcacagagacggccaaaatgtatgctgtagacacaagggtgtaaaatgcacgtttcagggtgtgtttgcatatgatttaatcaatcagtatggttacattgataaaatagtaagtcaatccaggaacagttatttagaattcatattgaattaaattaattgctagcttaatcaaaatgtttgattctcctatactttttctttctattactcttatattttcccgtcattctctctgctaaccttccaccttatgcacacactttccctatattttaagataagtctgctaggatgtagaaatatttgtttgtgatttctatatagctattagagattatgacatagtaatattaaaatgaaatgatacttaaacagaaagcaatttccaaagaggccagggaccctaatctttgaagagatgaagaaacttacttttctccctggcttttggttcactttttgtacttttaacaagtgggtgaattatttgataattttgaggaagattattcttttaaattcaaactagtatgtcaatgcctaccattactctgattatattaaaacagaaaaaggaaataacaacttcgtataccagccactggtgagagttaaagacaagagctgcccccccacccccaaatgtcaaaggcaaatgctaaattgatactggagctcgtggtgactttctacctcactaacaacataagggatctccatattatttcaccactattctagcttgctgatatatgccaaatgattagactacagaatagttcaaccagagaatttactcatttattgattaaacatccaaatactattgtaatatactatgttaaaattcatcaattcaagtgcccacacaccactgaatcatcagcaccaagcaatatattagacatatggcaaaattcaacaaatatattttgatataaataaataaacgttcacgactttacttaaaaaatcaatgttgcggctgggcacggtagctcgcgtctgtaatccccgcactttgggaggccaaggcgggtggatcacgaggtcaagagaatcgtttgaacccaggaggtggaggttgcagtgagcggagatcgcaccattgcactccagtctggcaacagagcgagactccatctcaaaaaacaaaaataaataaataaataaatattcttcataaaatgtgggttttggggaaaatatagaattacatatacatttaacgaagtcgctaatgacatttcattcatattcataatgtaaccatcttgaatttttttaattgtagcgattttaaaaatgtttgtaaaatttaatttccagttttctaattacttgtcagtcacattaataacattagtacctttatggtacccttgcagtacctgaaaagaatatcaacctgaaaagaatatcaactcacccagaaattagttctttgaaaaaaaagaaattaagttgtgaatttctaaagaccttgaaataagtgtttcaaatttaaagaacaaagaatgatgtgaaaatgagattatgattcctactacatgaattaacgtttcgagattgctgtttattacttcccagagtatctttaacagtattctctgaagcagttccaatctagttggagaattaacagcaattgatttaactatctcatttttattaactgtaatttactttaaaaatatttgcaaatcatactcattagttatttgatcattgttctatgcattttaaaattaattttgtgttgttcctctcaatatttgtttttaacatttattcccatttttattttatactattgtctgtcatgctttatgtattccaataagtgtcttgaaatccttgtggggaaaggcaggacaaaaataattagttaattagatttgaaaaatgtaatttttccattttaaatatttcatttgtataagaaaatatttcagagaaccatgatgataatggatatgtgtgactgttttgaatttttttctcaattaaaacattttgtatgtaat

SEQ ID NO: 61547 - DNA, 478 bp, Homo sapiens
cagagaatttactcatttattgattaaacatccaaatactattgtaatatactatgttaaaattcatcaattcaagtgcccacacaccactgaatcatcagcaccaagcaatatattagacatatggcaaaattcaacaaatatattttgatataaataaataaacgttcacgactttacttaaaaaatcaatgttgcggctgggcacggtagctcgcgtctgtaatccccgcactttgggaggccaaggcgggtggatcacgaggtcaagagacggagaccatcctggctaacatggtgaaaccctgtctctactaaaaatacaaaaattagccgggcgtggtggcggtgcctgtagtcccagctactcgggaggctgaggcaggagaatcgtttgaacccaggaggtggaggttgcagtgagcggagatcgcaccattgcactccagtctggcaacagagcgagactccatctcaa

SEQ ID NO: 61548 - DNA, 526 bp, Homo sapiens
gcagcggatcttgcaaatgttcactgcccagagcatgtgttccccactgtgcacaccctcccagccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 61549 - DNA, 747 bp, Homo sapiens
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaacacaaaacaaaaaatgaagccggattcaattcactgggccggcgtttacaacatcgggaatggaaaaccctggcgtaccaacttaatagcctggagacatccccctttgcagctgggggaataaaaggcccgacccatcgcccttccatgggaacctgatgggg

SEQ ID NO: 61550 - DNA, 220 bp, Homo sapiens
tcaagcttctaacgatgtacggggacatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 61551 - DNA, 707 bp, Homo sapiens
  misc_feature (641)..(641): n is a, c, g, or t
  misc_feature (643)..(643): n is a, c, g, or t
  misc_feature (655)..(655): n is a, c, g, or t
  misc_feature (663)..(664): n is a, c, g, or t
  misc_feature (667)..(667): n is a, c, g, or t
  misc_feature (673)..(673): n is a, c, g, or t
  misc_feature (675)..(675): n is a, c, g, or t
  misc_feature (684)..(684): n is a, c, g, or t
  misc_feature (686)..(686): n is a, c, g, or t
  misc_feature (693)..(693): n is a, c, g, or t
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaaaaaaaaaaaaggggggggggcaaaaanancccgggggggcncaagttannggncgaccnantttttgggnanaaggggngcccaaaagggagc

SEQ ID NO: 61552 - DNA, 733 bp, Homo sapiens
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcgcacaaaaaaaacccccgggggggggc

SEQ ID NO: 61553 - DNA, 627 bp, Homo sapiens
ggcagttgaggcaggagacatcaagagagtatttgtgccctcctcgggttttaccttccagccgagattcttcccctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 61554 - DNA, 715 bp, Homo sapiens
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcgcacaaaaaaaacccccgggggggggc

SEQ ID NO: 61555 - DNA, 710 bp, Homo sapiens
  misc_feature (632)..(632): n is a, c, g, or t
  misc_feature (641)..(641): n is a, c, g, or t
  misc_feature (666)..(666): n is a, c, g, or t
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaaaaaaaaaaaaaaaattanaattttatnttataggttgatttttttcaaattnttttataatcatgataataatattttagatccgttataaaaaaa

SEQ ID NO: 61556 - DNA, 604 bp, Homo sapiens
gtgtgcgtgggtgtgcatggcacacacacacatgcacgtaagacggaggaaaaaacaaacagaaaagtgagcaagtgactgaatttgagctctccaggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 61557 - DNA, 782 bp, Homo sapiens
ggcagttgaggcaggagacatcaagagagtatttgtgccctcctcgggttttaccttccagccgagattcttcccctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcgcacaaaaaaaacccccgggggggggc

SEQ ID NO: 61558 - DNA, 578 bp, Homo sapiens
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 61559 - DNA, 637 bp, Homo sapiens
gcagcggatcttgcaaatgttcactgcccagagcatgtgttccccactgtgcacaccctcccagccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaaaaaaaaaaaaaaaaaaaaaaaaaaaaaaaaaaaaaaaggggggggggcgcacaaaaaaaacccccgggggggggc

SEQ ID NO: 61560 - DNA, 737 bp, Homo sapiens
  misc_feature (627)..(628): n is a, c, g, or t
  misc_feature (737)..(737): n is a, c, g, or t
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaaaaaaaaaattaannaccgatttacaattcactgcccggcggtttaccaccgtcgggatgggaaacccctggggttcccaacttaattcgcttgaagaaatcccctttggccagctggggaaan

SEQ ID NO: 61561 - DNA, 812 bp, Homo sapiens
  misc_feature (588)..(588): n is a, c, g, or t
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaanaaaggtgaataatactctgaataaggatttctataaatacgctcagcaccaaggcctcacagaaaatcgaaagggggccaccaaaataaaaaatttcgtgaaacccctttggggcgctctggcccaaaggttttaaaattgagaaagtttttcatgggcccaatattggctaaatggccaattcccctatagggggtgttaaaatcacgagccggtgtaacagg

SEQ ID NO: 61562 - DNA, 696 bp, Homo sapiens
  misc_feature (630)..(630): n is a, c, g, or t
  misc_feature (632)..(632): n is a, c, g, or t
  misc_feature (644)..(644): n is a, c, g, or t
  misc_feature (652)..(653): n is a, c, g, or t
  misc_feature (656)..(656): n is a, c, g, or t
  misc_feature (662)..(662): n is a, c, g, or t
  misc_feature (664)..(664): n is a, c, g, or t
  misc_feature (673)..(673): n is a, c, g, or t
  misc_feature (675)..(675): n is a, c, g, or t
  misc_feature (682)..(682): n is a, c, g, or t
ggcagttgaggcaggagacatcaagagagtatttgtgccctcctcgggttttaccttccagccgagattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttaaaaaaaaaaaaaaaaaaaaaaaaaaaaaaaaaaaggggggggggcaaaaanancccgggggggcncaagttannggncgaccnantttttgggnanaaggggngcccaaaagggagc

SEQ ID NO: 61563 - DNA, 351 bp, Homo sapiens
aggacttaggtttaaaatgtttaatccaacacaatggggaaaacagaaaatataccaataatgtgaaaagtacaagaagctacaagggtgacaagtcatatttgtttgttttttgtgcatgtgggggtttttttgttttgttttgtttttttgttttttgagacagagtttcactcttgtcgcccaggctggagtgcaatggcatgaccttggctcaccacaacctctgcctcctgggttcaagtgattctcctgactcagcctcccaagtagctgggaatacaggcacccaccaccatgcccagctaattttgtatttttagtagagacggggtttctccatgttggtca

SEQ ID NO: 61564 - DNA, 561 bp, Homo sapiens
aatatcagcctttcatttctgatatttggtctttgaagaggaaacataatgcaatagtaattcataatagtggagggttctttcctcacatccttgaaagccaccagtcttattcttcagcctggctcttgagctattgctgtattaattttaaatagggtgtgatagcataagctgatggaagcctgcagagatctcactttgaaatggtgatacattacatgggaaaagattagagaggtgttttatactgcacatcggtgaggcctaataagaaagtagaatagacgtaaaccattgttttcatcatcctttaagacagggatttcaaactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaa

SEQ ID NO: 61565 - DNA, 321 bp, Homo sapiens
cacccacccatgtgaattgtatgtattagattgctcctattttaagtcagctcatcccatatatacctttcaaatgtggtgaaactgtgcagtagaaattggttttttgtcttaacctaggtaagtttttatggttttttggttttgatttattcagcttttgaaagaggaatactaggtaagtttttaaatagtatttcattttgttataataaatgataaaatagattattggcattagtcatgtagctttctgatttgggcaagactggcttgaataagtatgaatatttttggtctgctaatcatttttctaataga

SEQ ID NO: 61566 - DNA, 433 bp, Homo sapiens
gaggaaaggcaaacttacgagtataaaatggaatagaacattccaaatacggcaggaagcaaaaggccggtggtcacagtagatcacaggctgaccacagatgtgcatgctatgtttctgctagaaaggaatgttaatagcaattaaaggctattatttggggcaaatgagggtaaggaggccccagagctaggcccaggggactctggaattgctttgtgattccagagctatgaaacagctgccaggacaagttgccagggcagaagcaagcaggaggaaatgtcctgggaagggctgggccctttaagtggtggctgggccaaagcaatgaggccttcaaaagggaacggtcccaaagaagatggaggaaaggagtagagaaaggaagctggaagttcaagttatactcctgtttataatgtaatgtagg

SEQ ID NO: 61567 - DNA, 167 bp, Homo sapiens
cctgggtgacagagtgagattccatctcaaaaaaaaaaaaaaaaaaaaaaaaaaaaaaaaaaatatatatatatatatatccccacgtgctactactgcagccagctttaatgacaaatgatacctactggcttcaaggttgacccacagaaccaatacaaaatctg

SEQ ID NO: 61568 - DNA, 263 bp, Homo sapiens
tatgtggtttaaaaatggtcataaaaaggacactaaataacctgattaagctagagtatagaccaaattgccacttactttgaattgtttttaccaaaggtatcactttgaataaagataactttcatttagacatctatctttatgtgttcctgccatcatttcagtgagatcagaggaaagttaaattagaacaatgaaaaagcttaagaaatgaacaatcatcatgcttttgtgtatgcttaaagtgagtacatgtaaaa

SEQ ID NO: 61569 - DNA, 3571 bp, Homo sapiens
  misc_feature (101)..(101): n is a, c, g, or t
acagctgggagagcgcaggaaggcgccgggaaggaaagccagcccaccagcgtctgggtgggctgcgccgcgcggctggcggaccttcccgggttggagangtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagtatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 61570 - DNA, 3608 bp, Homo sapiens
  misc_feature (241)..(241): n is a, c, g, or t
agttataagagacaggaataccagtgagaagtatgagagagtgggtgggagataatgtttagaatctcttttgctgcccgcaatttatgaaaatggcttgaaaatatttatggtcaaagaccgaaatatttcttcaaagaagattagctttgctccattaaaagtaatgagtagaaatattaaaaaaaaaaagttttaagtacctgagtatcttgccagcaactgaccaccactgctaaangtgaggagagacacagctttcatcattgggactgcagtttatttcaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagtatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 61571 - DNA, 3690 bp, Homo sapiens
  misc_feature (101)..(101): n is a, c, g, or t
acagctgggagagcgcaggaaggcgccgggaaggaaagccagcccaccagcgtctgggtgggctgcgccgcgcggctggcggaccttcccgggttggagangtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccagaataaatgattcccactgatccacccacttttgccaccccaggatgcaattttctggagagaagattagtggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagtatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 61572 - DNA, 389 bp, Homo sapiens
agtgatttttaaataacttgctaccacatcacttcacttcctggctctatcacttctacagtctttacagacaaaatacataggcaacatttggagaagttttttttttacaatctttatatgagtttgtagagaatgtctaaaacaatcataagtatgagattttattatacaatcattgcactttttccagatcacaacatttaaaaaattctcccaaagttaaaaaaaataaacaagtatcttgaggaacatagggaatgtaatataatattcctcaatgaaaacacagccagagaactatttggaggaaatgcattgaaacaaattacatgtatatttttaaacaactgattttccctttattagcttaaaatgttataatcatc

SEQ ID NO: 61573 - DNA, 248 bp, Homo sapiens
agcatagctctaggctataagccacagtgacccaattaattggtttttgagagtttgctgacctttggtagactaagagataaaatgaaaagtggcattccccacttttgatgattagctaaactatgtatacacagcaagttattaaagaaatgaattaagtattcacagcttgtatgggaggtgcattataacagagtgggacagagaaaagtggaagatgcccacagatgaactaccggagttgt

SEQ ID NO: 61574 - DNA, 223 bp, Homo sapiens
ttcaaataaaagaattcactaaggtaccaaaacagaaaatatacagagatcaatgactttcatatacattaacaaacaaaagttcagagataaaatggaagagaaatgctgtttttaacagtataattaagataaaatatgaaggtataaacttaacaagaaatgttgcaaaaccattatgtgaaaattacaacactcctgaagacgcagacacacctaacaa

SEQ ID NO: 61575 - DNA, 444 bp, Homo sapiens
acttatcctggcaaaccattcatcctcaattcatggatctgactgtaaggaagggtcaaattacgtacgagtcttccaaaaccagaaacctaaaggcagaaatgtggttactgttcctttagagaggatacttccaaagagaatctatacactatccaggagttctttattaatattctaagtataaatatctcagatgatccaataagcaatttgggatagtctgtaaaaatgttcaaagcctctggagacccttaaaaaaatactgacacctggctcccacccacagttattctgatccaatttaattgggtgagatctggggactgggattttaaaaactcccactcccaaactctaatgtacagcaaaatgtggaaactactgctaaagaaaatgatgtcttcaaatttgtccaccttcaagtctgggttggagagaaaa

SEQ ID NO: 61576 - DNA, 633 bp, Homo sapiens
gtagtaggggctggggataaagcaagaaagatgagaaatgaggtgtaggggtcttgcacagaccagggatgataatgggccaagaaccaaagagtatgaataattcagcctcatcttcctggggctaccccagcagagttgttgtctctgctctgaccatatcctacataggtctgtccccagcttctgcaaccttctgagactatgctaagaagccccttcagctaaggagccctttgtgctgagagctggcagtacctgggagcgtttggccccataagcagcccgcagccagtggtgatgaccaaggtgtgcaggtgtgcaggtgtgcaaaagcctcgcaccaggactgcagaggaacttgggccccagggctccctgcggacccgcggcagctgacactgcacttgtatcaacctcctgacttggctccttcccagctggtgtcacctactctccgatttctcctgggggaacttccttaacatatcatttgcacctaagactctgtctctggtgtgcttctgaggaaagccacctaaaactatttccaggatgaaaaaaaactaaaattgctatcaccaacctcatgcatgcaaagaataaaatgtactttcctataactccaccaaa

SEQ ID NO: 61577 - DNA, 395 bp, Homo sapiens
gtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaa

SEQ ID NO: 61578 - DNA, 826 bp, Homo sapiens
acacacccctgttctgcagggtcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggaggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatggaaac

SEQ ID NO: 61579 - DNA, 772 bp, Homo sapiens
tcctcacgagtatcagagaaggcataatctgtacacgtggcttcatttaaaatgaaaatatcaagcagtgtcattttcacaagtatccccacactgtctgaggctgaaaagaagagtgtagctatgcacactgcagtaagaagaaaatttcagctcaattggaggatgtaaagattgaaataccactgctcctagttctgatgcaaaattgaaaagagtgcactgggtcttcaaatggcatattgacaaggagaaagaggaaaggatgccccaggacagcctgggggtcaaggctgggctcaggcatgcctggacaagccatgcaagttgtctccggacttgaaccacgtatcagaggagctatttgaggaggcacatcagcatacctgcttctgtgggcccccaggctgtggtgctcagcccttgcactatgaaacattttttttttccagaagccaaagctttgagcatctcctcccatgtagagagtgtatatgtttacgtccatgtctttcgccatgtgaacgcatgcaaccaccacctcaaatatcataaatcctctctctccccctttctgtctgcctgtttatctacaatctgtctatttaaattctttttaaacaagaagggaatatctttatgcctgtttgtagggatattctacatccatctgttatttacatcattcgttttcctgaggtgtctccaacaaatcctggctggatgcactgtatgtgttattaataaaacagctgtaaaaatattaactgta

SEQ ID NO: 61580 - DNA, 578 bp, Homo sapiens
tcctcacgagtatcagagaaggcataatctgtacacgtggcttcatttaaaatgaaaatatcaagcagtgtcattttcacaagtatccccacactgtctgaggctgaaaagaagagtgtagctatgcacactgcagtaagaagaaaatttcagctcaattggaggatgtaaagattgaaataccactgctcctagttctgatgcaaaattgaaaagagtggctcagcccttgcactatgaaacattttttttttccagaagccaaagctttgagcatctcctcccatgtagagagtgtatatgtttacgtccatgtctttcgccatgtgaacgcatgcaaccaccacctcaaatatcataaatcctctctctccccctttctgtctgcctgtttatctacaatctgtctatttaaattctttttaaacaagaagggaatatctttatgcctgtttgtagggatattctacatccatctgttatttacatcattcgttttcctgaggtgtctccaacaaatcctggctggatgcactgtatgtgttattaataaaacagctgtaaaaatattaactgta

SEQ ID NO: 61581 - DNA, 623 bp, Homo sapiens
ctcatgaggcaggagaatcgcttgaacccaggaggcggaagttgcagtgagctgaaattgtgtcactgcactccagcctgggtgacagagcaagactccgtccaaaaaaaaaaaaaaaaaaaaagggaccatgttctagtgtaggggtaagtggattgttttggccccaaccccaagaggatcaagggagaccactgcagctgcccgagaaattcttgccctctgacaagaaacaccctatccagtctggggaatttgccagtccaacccctccccttggctcaagattctgggaaatcctaaatagtgtttaccattggccttttatcagctccagtataaatgcgtctggccagacttgctttacaactatgcataatggatagttgggccaggcttggtggctcatgcctagtgctttgggaggccgaggtgggaggatcacttcagcccaagagttggaggccagcctaggcaacatggtgagacaccatctctacaaaaaaaaattttattttctgttttttttttgagacggagtgtggcgctgtcacccaggctggagcaacagagccagactttgtctcaaataaataaataaataaataaaacctgcaaaaaaa

SEQ ID NO: 61582 - DNA, 176 bp, Homo sapiens
  misc_feature (1)..(1): n is a, c, g, or t
  misc_feature (3)..(3): n is a, c, g, or t
ncngacaggattttgagaaacaaagggatacttttagaagactatttctctaggggtgaccctatgcacagaggccctgaagcagatgacagcagtaggaagagagggcaaaggggaaagactccatgaccttcaagagatggcacactctgattattgaatacaaaggaaaatgc

SEQ ID NO: 61583 - DNA, 178 bp, Homo sapiens
catgtttttgtaaataaagtttcactggaatgcagccacacccattggtttacatattgtctgtgcctgctttcatagcagagttgagtagttgagacagagatcctatgatctgcaagtctaaaatatttgtctctttaagagaaagtttgccaacctctgccctaggccttacttt

SEQ ID NO: 61584 - DNA, 329 bp, Homo sapiens
tagttccttaatccatttggaagagtctgacttattttctcttgaaattgtatggtaaatatgccaccactgtgtacaaatgatgacagttttgtgtcttgctgcccaatccttatgctcttcacttcattcctttgtgtgtttaggtgtgttaccgtgctgattaaaaattacagtataatgttgaagaaattataactagcaattaaaatgtgaatttttgtgaatttaatcagtgtaacatatctcatttttatattagtttgcatttcctcaattactagtgaaattgagcttttttttctagatgttcttggccacacaacttt

SEQ ID NO: 61585 - DNA, 2127 bp, Homo sapiens
  misc_feature (436)..(438): n is a, c, g, or t
  misc_feature (440)..(440): n is a, c, g, or t
  misc_feature (1869)..(1869): n is a, c, g, or t
cacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtnnntnttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctggtgaggacctgggcggcaggggtttgtggctgtgaggtacgggaggcagcccactccggcaagacccccagtccctatgcctctcttccccagaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctttgcgcgacgtggtcccacaaccgttgcctttttaagagaggcccggaccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcgganagaggcgccgggcggggcgggctgcgctttggccgggctcccaccgtgccgcgcggctcagcggctccttaatgcgagtcgcgtggctcttggccgggacgcgggagcgcgtttacagccggcgcagtccgcatccgcgacgagctgagctgggccgccgggccccggacgggccccgccctgtccctcgccgctcgcctacgcgtgacctgtgcggccgggtgtcctgtcagctcgatcggctgccggctgcctggg

SEQ ID NO: 61586 - DNA, 3086 bp, Homo sapiens
  misc_feature (436)..(438): n is a, c, g, or t
  misc_feature (440)..(440): n is a, c, g, or t
  misc_feature (2828)..(2828): n is a, c, g, or t
cacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtnnntnttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctgtgtggtttgtttttttcctggttccaagtgtgcatgccagccccagctccactcacctttttccagcttttggcctcttcacctctccactctgctctccttgacgccctgagatgagttgagcttgtttcttctcagtttccccagtcaggatgagggagtaggtagaggactatgtgatgccccttttctaaggaagaagccatagccttttcaaaggtagcagccagaggggtggaccctagccttgtctctggcagcacctctgcagcctcttccgccatctggtgtccattccccacctggaagtgaggttttgtgttccgatccccttgatagattcccctccttcccctgagcatcctgaccctatcagcctatcccatctcatgcccaccccaggtactcagacaccgacaggagtttgtggtgaccccagcgtcaggtggcacgttaggcaccaagtgtggacttgccagtctcctgactccactgttagatcattttccttgggtgtgggagcggggctgggcgcggcggggagacggggtagcaaaaagaaccgtgaagaaaccacgcctgcccccttcagccattttcccccactccgccgcatttttccatctcccacttgagtgagtgatgtcccgtccttttctcagctttgcgcgacgtggtcccacaaccgttgcctttttaagagaggcccggaccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcgganagaggcgccgggcggggcgggctgcgctttggccgggctcccaccgtgccgcgcggctcagcggctccttaatgcgagtcgcgtggctcttggccgggacgcgggagcgcgtttacagccggcgcagtccgcatccgcgacgagctgagctgggccgccgggccccggacgggccccgccctgtccctcgccgctcgcctacgcgtgacctgtgcggccgggtgtcctgtcagctcgatcggctgccggctgcctggg

SEQ ID NO: 61587 - DNA, 2200 bp, Homo sapiens
  misc_feature (436)..(438): n is a, c, g, or t
  misc_feature (440)..(440): n is a, c, g, or t
cacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtnnntnttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaaaaaccagatcaaccgaatcaacaaacacggtgggggcccatgccacggaaaacatctgacaacatgtctggcagcgggcccagtgtcagacaagggccatgcggcccaggaacaccgcagcacgcgggttaccacacaaagcgacgggcaccagtatgcaaaccacggctgggtcagggataaaaggcccggcactaaccgcccggcacgagcacacatgaacgcacagagcgacagcagacagaacacgactgacgtcacgcacaacacacaaggagcgacacgcccaggcaacg

SEQ ID NO: 61588 - DNA, 1825 bp, Homo sapiens
  misc_feature (8)..(8): n is a, c, g, or t
  misc_feature (12)..(12): n is a, c, g, or t
  misc_feature (19)..(19): n is a, c, g, or t
  misc_feature (1567)..(1567): n is a, c, g, or t
cctcgcgnagtnggccctngaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctgtgtggtttgtttttttcctggttccaagtgtgcatgccagccccagctccactcacctttttccagcttttggcctcttcacctctccactctgctctccttgacgccctgagatgagttgagcttgtttcttctcagtttccccagtcaggatgagggagtaggtagaggactatgtgatgccccttttctaaggaagaagccatagccttttcaaaggtagcagccagaggggtggaccctagccttgtctctggcagcacctctgcagcctcttccgccatctggtgtccattccccacctggaagtgaggttttgtgttccgatccccttgatagattcccctccttcccctgagcatcctgaccctatcagcctatcccatctcatgcccaccccaggtactcagacaccgacaggagtttgtggtgaccccagcgtcaggtggcacgttaggcaccaagtgtggacttgccagtctcctgactccactgttagatcattttccttgggtgtgggagcggggctgggcgcggcggggagacggggtagcaaaaagaaccgtgaagaaaccacgcctgcccccttcagccattttcccccactccgccgcatttttccatctcccacttgagtgagtgatgtcccgtccttttctcagctttgcgcgacgtggtcccacaaccgttgcctttttaagagaggcccggaccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcgganagaggcgccgggcggggcgggctgcgctttggccgggctcccaccgtgccgcgcggctcagcggctccttaatgcgagtcgcgtggctcttggccgggacgcgggagcgcgtttacagccggcgcagtccgcatccgcgacgagctgagctgggccgccgggccccggacgggccccgccctgtccctcgccgctcgcctacgcgtgacctgtgcggccgggtgtcctgtcagctcgatcggctgccggctgcctggg

SEQ ID NO: 61589 - DNA, 2106 bp, Homo sapiens
  misc_feature (436)..(438): n is a, c, g, or t
  misc_feature (440)..(440): n is a, c, g, or t
cacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtnnntnttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgctcacctcacaggagggccaggcatgtattcctcagaggcgacactgccaaactctttctcctgtctgggttggctggcactggggcgggcatctagcgtacagcctctgctcatggcactgcggcctccagttcttccacatgtgtgcacccccagcttggccagcctcagctcgcggggggcccgacgcatttcctacag

SEQ ID NO: 61590 - DNA, 2254 bp, Homo sapiens
  misc_feature (436)..(438): n is a, c, g, or t
  misc_feature (440)..(440): n is a, c, g, or t
cacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtnnntnttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctgaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaagaaaacaaaatgatcataaaataaagaaaaaaaagggggggggggcaaaaaaatccccggggggccaattttggttccccgttttttgttaaagggggcccactaggggggcgatattatagcggggagggcccggtttaaaccagccgtctgtcggtcggtgggacaaccgtggtcgtctggggcacccgtgtggggggcccccttctccgcgggggggcaccctttggggggccacctccccggggatttggggccccgggcaactatcacctcgccgttcaagggtgctcaccatgcgtctcttcgtgcctctgagagtttggcccggggttgacttgacccttttcg

SEQ ID NO: 61591 - DNA, 3179 bp, Homo sapiens
  misc_feature (436)..(438): n is a, c, g, or t
  misc_feature (440)..(440): n is a, c, g, or t
  misc_feature (2921)..(2921): n is a, c, g, or t
cacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtnnntnttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctggtgaggacctgggcggcaggggtttgtggctgtgaggtacgggaggcagcccactccggcaagacccccagtccctatgcctctcttccccagaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaacagctgttcctctgtgtggtttgtttttttcctggttccaagtgtgcatgccagccccagctccactcacctttttccagcttttggcctcttcacctctccactctgctctccttgacgccctgagatgagttgagcttgtttcttctcagtttccccagtcaggatgagggagtaggtagaggactatgtgatgccccttttctaaggaagaagccatagccttttcaaaggtagcagccagaggggtggaccctagccttgtctctggcagcacctctgcagcctcttccgccatctggtgtccattccccacctggaagtgaggttttgtgttccgatccccttgatagattcccctccttcccctgagcatcctgaccctatcagcctatcccatctcatgcccaccccaggtactcagacaccgacaggagtttgtggtgaccccagcgtcaggtggcacgttaggcaccaagtgtggacttgccagtctcctgactccactgttagatcattttccttgggtgtgggagcggggctgggcgcggcggggagacggggtagcaaaaagaaccgtgaagaaaccacgcctgcccccttcagccattttcccccactccgccgcatttttccatctcccacttgagtgagtgatgtcccgtccttttctcagctttgcgcgacgtggtcccacaaccgttgcctttttaagagaggcccggaccatccagagggggtggggcagaggcggagtctgaggagctggggaaggaacaaagcgaggcctgcgggcggcggctgggctccggcggggccgcggggtgcggggcctgcgggcggcggcccgggcggagcgttggagggaaggaggtggcatcgccgtccgcgccggccccggccatgaacgggctgccctcgganagaggcgccgggcggggcgggctgcgctttggccgggctcccaccgtgccgcgcggctcagcggctccttaatgcgagtcgcgtggctcttggccgggacgcgggagcgcgtttacagccggcgcagtccgcatccgcgacgagctgagctgggccgccgggccccggacgggccccgccctgtccctcgccgctcgcctacgcgtgacctgtgcggccgggtgtcctgtcagctcgatcggctgccggctgcctggg

SEQ ID NO: 61592 - DNA, 2293 bp, Homo sapiens
  misc_feature (436)..(438): n is a, c, g, or t
  misc_feature (440)..(440): n is a, c, g, or t
cacacaaaaaacggtggctctattcagcctgatagaaacgacttgtggtacaggccctaagtcaggtacgctgctgcccaagagcctgactggtagatggagatgtgaaagggacacagggctctccacgtaagcaggaggcagcaagaatgacagttccaggggttctacgtggaaggaagagggggccaggaggaagggacttcaggtcagattgagggggcatgtgccatccggaagaggagaatgtcgatgtaactgtgaaagtccaagtcctagctgcttttccactgccctggtgtacaacctcaggccctgcagactgcacatctgaggacccctgcctgccctgtctggcttctctgaatctaataagggagaagatgcgtttgaaaaagaacacggaagagggagagagaaaaaaagcaccaaggtnnntnttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctggtgaggacctgggcggcaggggtttgtggctgtgaggtacgggaggcagcccactccggcaagacccccagtccctatgcctctcttccccagaagtcgacgacttctcctgggagcccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccagcccccagtacctcgtccggagcactgtgagggagctgcagcaggactcaaggcagcccaggggccacctgctcctgctgtgcctccaaatacagatgtcatggcctgcacacagacagccctcttgcagaagctgacctgggcctctgctgaactgggctctagcacctccctggagactagcatccagctgtgtggccttatccgcgcatgtgcggaggccctgcgcagcctgcagcagctacagcactaagagaagcccctgagaaaaaccctctagaaaaaaaaccagatcaaccgaatcaacaaacacggtgggggcccatgccacggaaaacatctgacaacatgtctggcagcgggcccagtgtcagacaagggccatgcggcccaggaacaccgcagcacgcgggttaccacacaaagcgacgggcaccagtatgcaaaccacggctgggtcagggataaaaggcccggcactaaccgcccggcacgagcacacatgaacgcacagagcgacagcagacagaacacgactgacgtcacgcacaacacacaaggagcgacacgcccaggcaacg

SEQ ID NO: 61593 - DNA, 410 bp, Homo sapiens
agttaaccttattcagcttcttttcttcatttgtaaactgtttataccagtttctttccaaaattatgattctatgatctgttcaatgctcttttatatgttaagacattgttttctctcataatttccaaactatgggagaatttgtggttttttccccatatctgaggagaacgtccactgagttcttatctacagttacactagtgaagaacgctgggtctggaatcagaagcctcaggtcttagttctgtcatcaactatttgtgcgaccttggacaaaagacttgatcacccacagtcccagtttcccacaaggttactgtaaagcacacagttttaaaaaagacaaaatacacatgatagtatattaattgtactttctattaaaaggcaaggtgatgttatgc

SEQ ID NO: 61594 - DNA, 873 bp, Homo sapiens
tcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaa

SEQ ID NO: 61595 - DNA, 1471 bp, Homo sapiens
tcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaaaaaaaaaaaaaaaaaaaaaaaaaacaaccacggttggggaccccagccggcgacccacacggaaaaaaagatcttcaaagaccccaatacggtatgtggggcagcggagccacagagacgtaaaccctgcaaccggcgcccacccgccttatccacccaagaaaaggcaaggggggtcaaagacccaaacgaggcgggacctcccacccccaacaaagaaaacggcccggcggggacaccggatacgttgactgacacaacaccacaaaggagcctcgcagcgacacggcgacccctacccacacggcaccccacgggggcccagaaataacaaaaatcgcccgacgggggaaaaagcgaacaacactaaaaaaaaacacagacaagagacacaaatacaaaaagaggaaacgaaaagaacagaaaacaaaaaaaactaaaacaaaaaaggaaaacgaaaacaaacagaaagaaagcaatgataaacaaacaaaaaaagaaacaagataaaatagatacacaaaacagcaagacaggccagaaaacagacaacacaaaaacaaagaaacaacaacaacaacaaatctaaaaaacataa

SEQ ID NO: 61596 - DNA, 746 bp, Homo sapiens
tcctccacctgctggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgtctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaa

SEQ ID NO: 61597 - DNA, 497 bp, Homo sapiens
cacagatgctgtgaaggtcgtggagttgcccaccgaggaacccgaagtggggagcacctgtttggcttccggctggggcagcatcgaaccagagaattgtatgtgggggcagactgtgtagcccaaggcggggatggggactcctgcgtccaagggagaaagggccagggaagcaggtgaggtcgggctgcagccctttttctcccgggttcgtagtctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtggtgaggcagccctgcccccagggtctggaagggctgagggaggggactcagcctctgaactggcttctgagagctaaccaggcatctgcttcactgcttcccagctagctgtagccactcgccccatcagtgccccagctcccc

SEQ ID NO: 61598 - DNA, 867 bp, Homo sapiens
tgatgtacggctcgggatacgggatctgtcacatgtcgttctggttctgtgctcgcctgtcccttggggggacttggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagatgctgtgaaggtcgtggagttgcccaccgaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaa

SEQ ID NO: 61599 - DNA, 402 bp, Homo sapiens
tcctcttcccttcctatcattccatcccttcaaggctgtctggctcccaggccctaacaggtcttcactcataatctccacttcatggtgtgttaaggagattattttttttccccatcaataaaaaccttttaatcatttttctggggatgggtggcttcaaaaaatgtggtacaagaatgacagtctagggcccagaccaatggttcccaaagtgaggtcctgggaccagcagcattagtatcacacgggaacttataagaaatgcaaattctcaggcccatcctcactagtaagaaagaatcagaaattctaggctgggcacggaggctcacgcctgcaatcccagcactttgggaggccgaggcgggtggatcacctgaggtcaggagtttgagacca

SEQ ID NO: 61600 - DNA, 356 bp, Homo sapiens
attcccagaggaaattagttcatttatccatcagaaataagcaaatattgtcaaaattcataaacaacccaaatgtccgtgaatagtagaataggtaagtaaatcatggtatatcatatgatggaataccatacagaaatgaaaatgaacaaactactgctgtatcacaacatgggtgaatttttttttccataaattcgaccaagtggtaagcatagataaattttatacacataaggccaggcgtggtgtcacgcctgtaatcccagcactttgagaggctgaggtgggaggatcagttgaggccaggagttcaagaccagcctggccaaaatggtgaaacctcatctctagta

SEQ ID NO: 61601 - DNA, 389 bp, Homo sapiens
cggcacgagggtggaagggagagaaagagaaagaagaaaatggcagaaatgcacagtgccagttccagatttagactttaagatggctgacttcactgtcttggagcctggtgccatcacttaaagaagtctgatcatgctgcaggagagagaccactccatttggaaagaggtcctgaagaacaacaaagacatggagagaggcccagccagcccccaactgtcccagccaggtcagccaagggcatgtgaatgaagggaagccagcttgcatcttgcagtctgtgttgaactaccccagtcaacaccatatggagcagagatgagccgtctcactgagccctgccaatattgaagaagcaggacaaataaattgttgtttaaagtca

SEQ ID NO: 61602 - DNA, 349 bp, Homo sapiens
ggtccacataatagggtttaaagggggcaaatgatgcaatgggatttgtgttttggcaaggtcactctgaccacaatgtataagactacaagagatggaactgggggtaaaaggaaggaaataatgagggccaaaaccaaggagcaaaggggagacagagagaaaagtgggatggattcaaagacattgcaacatagaactgaccgaactggcttgtgtgaggtaagggaggcaggatgactcacaggtttctggattatgtgaacaggtggaaggtgatgccattagccagaataaggctgtaggctaaggggagtaaactggttctggggtataacattgataggcc

SEQ ID NO: 61603 - DNA, 436 bp, Homo sapiens
gttctaagccaagatactgaatgtaatatgaaacactatgaagaaagattggttaatttatgataaggtgtgttacagtctatttgtctttttaaggtaattgaagcagtgtagagagaaattacagggttctgtagaagagtctaacccatttggtatgtgagcatgaggatacatttgggtggtgaggtctattaagataacatcattacattaattacaggttggaagtaatgttcacatgccagtgacttggccttcttttcttattctgtctaatcctgttttggttcatgttagcagtgtgttagagtgaagatggagcactagcccaaagtctagaagaatattggacaaccatcatctcccactctcctccatattacagtgttttgggggctttcttagattattaaaaaaattgtttggctctagt

SEQ ID NO: 61604 - DNA, 186 bp, Homo sapiens
gcagtggatctttctttttttccaaaggaaatttcatatagagtccattcataggaaacagataaaatgtgaacggctgcaactgagatgggggagagtggcttggagcccccagcctctttgctttctcttatccctataggatggccattaggtgaagcagtttagcttgttggttcagacctg

SEQ ID NO: 61605 - DNA, 109 bp, Homo sapiens
ttttataaacatgtattagtatttgcacttgtatagtgcttactatgggctagaaactttctagacgctttagagatgtgaactcatctaatatatgattattaacccc

SEQ ID NO: 61606 - DNA, 615 bp, Homo sapiens
attcggcaagggggatttaagtgagctctgaatgacaaaaagccaaccaagggaagacaagaaggaagaacattccaggaaaaggcaccagccaagccttagacactaaagaagaaactatgttctatgctcaaaaaagatgaacaagaatcactgtgactaaaaagcaagtggttgaggggaagagagacacaagctattgtaggggtttgcaggtcagtgtgaggagtttggattttattccaggtggactcctcttcctccacacagtctccttatgagatctcactccatttcagttttcattcctatcttgtggttttatgacaactcccactccaacttttctctacaatgcaggccagtcctatgcaacagcatcctgaactacatccatacttggatttccactgatggctcattaaaaagtccctaactgaagcccgtctcttttcctcaaacactattctttcttctttttattgacaccattatctacccagtcacttaagccagtagcccaagatccaatctagctttctgtcatctgcaacatctaattattaacactgatttttctaagtttaaggtaaagatatagaaagaaggaaagca

SEQ ID NO: 61607 - DNA, 395 bp, Homo sapiens
  misc_feature (214)..(214): n is a, c, g, or t
  misc_feature (349)..(349): n is a, c, g, or t
  misc_feature (363)..(363): n is a, c, g, or t
  misc_feature (378)..(378): n is a, c, g, or t
agcctgggcttcctgctgagacgggacccccccctctcttcttgatctcactcccaggaaagacactgaaggagcagaggtgtggacgccacatactggacggggtttcaccatctgctgggacgggacaccctctcttcttgatctcactcccagaaaagacactgaaggagcagaggtgtggacgcctcatactgctagagacggggtttcnccgtgttggccaggatggtctcaatctcctgaagtcgtgatccacccgccttggcctcccaaagtgctgggattacaggcgtgagccactgcacccggctgaaattgtatactttaaagggatgaattttatggnatgtgaattatgtntcattaaaaaaaacnaactgttaaagaaaaaa

SEQ ID NO: 61608 - DNA, 4599 bp, Homo sapiens
  misc_feature (1613)..(1613): n is a, c, g, or t
caataacccacgagatgatattgctacagaagcatatgaggatgagctagacatgggccgatctggatcctacctgaacagcagtatcaattcagcctggagtgagcacagcttggatccagaggacattcgggacgagctgaaaaaactctatgcccaactggaaatatataaaagaaagaagatgatcacaaacaacccccacctccagaaaaagcggtgctcgaagaagggcctaggtcgttccatcatgagacgcattacggagatcccagagacagtcagccggcagtgctctaaagaggacaaggagggcgccgaccatggcacagccaaaggcactgccctcatcaggaagaaccccccagagtcttcagggaacacagggaaatccaaggaggagaccctgaaaaaccgagtcttctcactcaagaaatcccacagcacttatgaccacgtgagagaccaaacggaagagtccagtagcctacccacagaaagccaagaggaggagacaacagaaaattccacactggaatccctgtcgggtaaaaaactaacacaaaaactaaaagaagacagcgaggctgagtccacggagtcggtgccgttggtgtgcaagtcagcaagcgctcacaacctcagctcagagaagaaaactgggcacccacgaacatcgatgttacagaagtctctcagtgtcatagcaagcgccaaggagaagactcttggattagctgggaaaacccaaacagcaggtgtggaagaacgcactaaatcccagaaacctttgccaaaagataaagagacaaacagaaatcactcaaattctgataacacagagactaaagatcctgccccccaaaactcaaatcctgcggaggagccaagaaagcctcagaaatctgggattatgaaacaacaaagggtcaaccccaccactgccaattctgacctgaacccaggcaccacccagatgaaggacaactttgacattggggaggtgtgtccttgggaggtttatgacctgacccctggtcctgtgccttcagaatcaaaagttcaaaagcacgtatctattgtggcttctgaaatggagaaaaaccccactttttccttaaaggagaaatctcaccacaagcctaaggcagctgaggtttgtcagcaatccaatcagaagcgcatagataaggctgaagtatgcctttgggagagccaaggccagtccattttggaagatgagaagcttttgatttccaagactccagttctcccagagagggcaaaagaggagaacggaggtcagcctcgtgcagccaatgtgtgtgctgggcagagcgaagaactgccccccaaagctgtagcatcaaaaacagagaatgaaaatctcaaccaaataggacaccaggaaaaaaagacatcttcttctgaggagaatgtgcgtggctcctataactcaagtaataacttccagcaacctttaacatcacgagcagaggtttgtccttgggagtttgagaccccagctcaaccaaatgctggaagaagtgtagctttacctgcctcttctgctctaagtgcaaataagatagcagggcctaggaaagaagagntctgggatagttttaaagtgtagcatctccaggaagaagaggaaaaggagggaaccccggattggatatgagacagaagatataagaatcaaatattcccaaggaggatttgtcaatcaaggaaaacatgacagatggtgaggtaaagtcaaaggcatgggtagaagaggaccaggggggcaagagcaacaacgtcataatggagaagtcagactttggtcaagaaagtccttcccttggtaacactaggaaaatctttccatttcagcatgtttaaggaaaatagcccacaatgtctgccctgatcaatatgtatccatgggactttgaagatcctaagccaggtaaaccaggagacacagaagacgtaccagatttgcaaagaaagaaaaggtataagacatatataactgaaattctaagtagctgaccgagaagaacttactttacctatttaaccttgatagcactgctaacttaatgcatcccaaaaatatcttttatattaatgattgctctcattttcttataaatgtatgtttcagtatatcgttgtgtctcatattcaagcattccagattgtataatttttgcaaataactttggtattatgtgacacaacacatttatgcaatctgcagctattcaattgttattgcaccttacagaatacctgctatctatcaactttagttgattcttgaagtacagtaagctttctctggcttgggaagccataactgttactataaaaacttttagttttggctgtggtttatatattgtgactttgaatttgactctattatttcacatcatggtttgttatactgtcttaatcagggttttttatacaagttgagttacttgttttgcacttcttgttaggactcagaagctttattaatattggagatcaagtggtcctacttagtcatatgtctcaataagttaaggacaacttatccgttgtttattcaaagtcagagatagataacgccttcattccaattaattgtcccttttaactctttcagtatttcctacttagcagcatttccaaaggaagaagctaagagtgagaaaaatataccgtgcattattattactattggaaagggaagactctagggatgacataagaattatagcagtactataaacccaggaagtttgcctttcaaaaaaaaacacaggtagctcctgatagcactttcaagggattatttttttaaagagaaaaattatggtagcatcaagatcattgtatggatatatttttattatgtgtactgaaaatacagtattttaaaataccttaaagtatttattctcataaactcttattcattgcttcagctacaggtagaacttgctgggctcaaatcccaaagaggttttataaccttatttattcaaaacctataaggtggtatggaatcttcattctcccaagcactggaaaatgtctaagtcctgcaaattgccattgtgagccacttgctcgacatgtaacatgtaaggtccatttgcaaagcaaagcagcccccaaagcatattttataaagcttattgcattccacactgatctcttggcatgggaatcctaagctgccgactaagccctaccgacatgatcatgcagtgagattccaaagctcagtctcatttcatttaaagaagaatcactcagaaatagaaccgagacttccctttttctccctgtaaacacccaagtatcaactgcttatttggccaggacactcccagcacaaataactattttttatgtcacaagcagcaaggaggacatgctagggtgataaaagatggagaaacaggatcagagggtggatatagggctgttcttagagagtattttcagtggaaggtaaaaacagaattctccatattcatcatcaaatttttctcagtgatttttttattcaggagtaagcaagcacttcactgtttcacaaagctgtgcgcaaatcttcctcacccatttgctgactttatgcattactcaggttggtggggtcggtttgagaagatatagaaattctatttttgtgtctttacaccatttatttcttttatctcttccttttcaatgaaggcctatatgcttggtgacctcctttaaggaatctttgtgaactgggttggaagttcctagacccacatatttgtttcatttatgtctgaaatctgttagcacttgattcctttcttgagaattatgcagtcaagcatcagtgactttctattgcacttcaggattgatcctgctagagatgtgagttaaaaagacttgccaaattatatcttagcgacattctatagttcatagattattctccaccagcataaatcagtgagagtgcctagagtctttctgagagtttcattgccattatcaacaagagaagttgaaatttacaagtcaggaggttatttttccagattgataaccatagaaagtgaataaacacttttaaggtcgcaaacatttgctaggttgtccttctcaatgcatgtgcaggctgcatcctgtccttgtttttaagccagggtttataaataagtagatttataccaatcttaatagaattgtatattttatgcaagaattaaatgctttacaacatgaagtataactcaacccattgtaaactttggtggcaatatggatttgaaactcgacagttctcttgtatttgcttcctaggtttctgcatgcaagttatgacaggtaggactgaaaaaacactgccttttgacttctagcatttagcaaccgagagtcgtagagtcaataaagctgtaagtgtcttcacttaatctgtggttctcctaaaactattatctgaaacctacagcatcccaccatgaaatatttggtaaatttatgttgtgacgtgttgcagcatgtaaataattataacttctctgcaataaaacatatttatatgaaaaaaaaaag

SEQ ID NO: 61609 - DNA, 379 bp, Homo sapiens
agcatctctgagtgaaaagcaattatataaacacaaaggaaccattattagagaaatcatatttatgttcccatattgtatgtggtcagaggaaagcaagacaagggcaagacttgggcaagtgacaagacgtattagcagtggcagcaacagtgctgggtaaacagttgtaaatctcaaacgctgagccgtgttaacattttacagaatgctttgatccttttcagtaagatacaaagcaagaataaattcacacagcctccttggaggtcagtgtgatttctctgtttctgtggaaaagcactaactagtcacatgctaattcacagtttgatgctcatcaaactggagcagatggttagaggtagggatgacatac

SEQ ID NO: 61610 - DNA, 1314 bp, Homo sapiens
agggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaagattgacatggtacatcgtaacaagtccgaaggattcttccttgatgcatctcgacacatccttgaagcacctcaacatggactggagagaaggcacttggaagcaaatcagaatgtacactaaataaacagtcaacttttggggtgtggatggaaggggggtccattttaaaagtgcttttacattgaatttccctcccagattagatcagcaaataaatgaaatttattaaaagaatgttgtgtctttaatagccatgctgttcagtgtagaaactttaaatctctcattaattttctgtgtattgtatcatgtacagcctgttagatatttgcaggttttataggttattcagtccaacgctttatttatttgctcttgttagttgttgctgtgaaacagtcatttcctttctggacatcaaagatattttcttggcattaattttaaactgatttcataaggtcaaagtattaaatgttttaattcagattgtggatagtttgtagtcctttgattttgcaaatgaaattaaaatgcctttgtttagatgttaggattaagtatagtagtgct

SEQ ID NO: 61611 - DNA, 1001 bp, Homo sapiens
agggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaaggtaatccattctataaatgtgacctgaaatggaacaagagagacgattgattattctgtgttcagattttttttgaaaaaaatcacaggtatctagtaatggcattttaacatgatgttgaatgtttcatctttttaattgacattttctcctttttcttatttttccatttcttgttatatatcattttctgtttgatttataaactctcactgtttcttagaaactttaatttgtacgttgaaaaataaattttattttgg

SEQ ID NO: 61612 - DNA, 824 bp, Homo sapiens
gttataatacagaactttgcccttaactagaagtttttgagcacatacttaaaaaatcagtagaaagtttgagagctcatttttacccaaatactaattttcatgttatttttgaacagatgcctttttggaaatcttaaaaaagcaaacatttcaaacagttggctaacacgcatgaactaacactcattcagtttttaaattacggatgatatccgtattaacattataatgactctatactacagattgacatggtacatcgtaacaagtccgaaggattcttccttgatgcatctcgacacatccttgaagcacctcaacatggactggagagaaggcacttggaagcaaatcagaatgtacactaaataaacagtcaacttttggggtgtggatggaaggggggtccattttaaaagtgcttttacattgaatttccctcccagattagatcagcaaataaatgaaatttattaaaagaatgttgtgtctttaatagccatgctgttcagtgtagaaactttaaatctctcattaattttctgtgtattgtatcatgtacagcctgttagatatttgcaggttttataggttattcagtccaacgctttatttatttgctcttgttagttgttgctgtgaaacagtcatttcctttctggacatcaaagatattttcttggcattaattttaaactgatttcataaggtcaaagtattaaatgttttaattcagattgtggatagtttgtagtcctttgattttgcaaatgaaattaaaatgcctttgtttagatgttaggattaagtatagtagtgct

SEQ ID NO: 61613 - DNA, 547 bp, Homo sapiens
  misc_feature (485)..(485): n is a, c, g, or t
taactcacttgtggcaggtctttattgaataaaggaggaataaacctagacagggagttagaaatgaaagacatttcaagacagttcaagggttatgttggtgacacttcttgtcttccagacagttttgaaagcacagatcttgcctcttgtgcttgttaaaaaatctgtgatacttctctgaagattttataattaaataagtgaaccattaccatgaccttttataaaagtgctgccctatttgaagtattgggttttttctcatgatgagctttgttagacttggtactgaaaaaatcagtagtttttttccttctattttaaaggcaaagaaatgcttgcttcagcctcccaagtagttgggactacaggcatgcgccaccacgcccagctaatttttgtattttttagtagagaccggggtttcaccgtgttggccaggatggtctccatctcttgacctcatgatctgcccgcctcgngtcccaaagtgttgggattacaggcatgagcactgcgcctggcaaatgttttagtttttatg

SEQ ID NO: 61614 - DNA, 3020 bp, Homo sapiens
agggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaagattgacatggtacatcgtaacaagtccgaaggattcttccttgatgcatctcgacacatccttgaagcacctcaacatggactggagagaaggcacttggaagcaaatcagaatgaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaataaaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctatttttttttttttttttggttgttgttaaacagaaccttaagtttatgtttgaggtatgtactgcataggaacctattttattattaaagatgaatgattaaaattgg

SEQ ID NO: 61615 - DNA, 3485 bp, Homo sapiens
agggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaagattgacatggtacatcgtaacaagtccgaaggattcttccttgatgcatctcgacacatccttgaagcacctcaacatggactggagagaaggcacttggaagcaaatcagaatgaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaataaaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctatttttttttttttttttggttgttgttaaacagaaccttaagtttatgtttgaggtatgtactgcataggaacctattttattattaaagatgaatgattaaaattggtatggtctccaatttaatttgaaaagtgcttacccttattcttatatatggtttaattttaaggttttttgtctcttcttagtgcaaaactacttagcagtgacctctatctgtattccttaggaattagcagcttcttagtgtggatcctgcagaacttcttaccatttgtagtaggttgaatcatgtcccctagaaggtaagtctaagtcctaacttgatacacctgggaaggtgaccatatttggaaatagtctttacagatgtgattaggggatctcaggatataattaccctggattttgggtgggctccaaacccagtgactagtgtcgttacaataagagaggaggagatatgaaacacagatatagcagcatgaggacagaggcaatgagttacgcaaggactgctagccaccaccagaagctgcaagagaggcatggaatgggttcttcacgggct

SEQ ID NO: 61616 - DNA, 4397 bp, Homo sapiens
taactcacttgtggcaggtctttattgaataaaggaggaataaacctagacagggagttagaaatgaaagacatttcaagacagttcaagggttatgttggtgacacttcttgtcttccagacagttttgaaagcacagatcttgcctcttgtgcttgttaaaaaatctgtgatacttctctgaagattttataattaaataagtgaaccattaccatgaccttttataaaagtgctgccctatttgaagtattgggttttttctcatgatgagctttgttagacttggtactgaaaaaatcagtagtttttttccttctattttaaaggcaaagaaatgcttgcttcagctaggcatggtggctcatgcctgtaattgggaggctgaggtgggtggatcacctgacgtcaggaattggagaccagcctggccaacatggtgaaaccccatctctactaaaaatacaaaaagttagccaggcgtgatagcgggtgcctgtaatcccagctgctcgggaggctaaagcaagagaattgtttgaacctgggagtgggaggttgcagtgagccgaggtcgtgccattgcactccagcctggcccaacaagagcgagactctgtcctaaaaaaaaagaaatgccttgccttcctgtgtagttttttaacttaggtcagtgccataggactgaccaaatcataaattgaggatgctgttggtattcaaagtttttactcattacccttactcagtttgcagctgcaatgatctgtacttaacctgcttttacatattatgcttccttgacaatgggaggaattttaatggttaacttgcagaatatgacagatacttgtcttaatatcattcttcctaccataatctaattcaaaactatccagtagaactttctgaaatgattggaatgttttttatctgtgctgtccagtgtggaagccagtagccacatgtggctgttgagcacttgcagtgtcactaatgcgtttgagggactgaattgttaatttttaaaaatgtattgattttaattaagtttaacattgttttggacagcacagattagccttttagagtaccttcttgctgagtactagcagtgtataggtttccccatgaaaaggacctacatttttgttggttaagaggttattaaatgtgctttgccaaagatactaccttgtcatttcttccagcttattagttccgtgggtttcttggagtactgttaaatcctttttacaaatatatatatacacaactactgaagagactgtttatttggggagttattcacttttatatttaagtcttaggcttaatatgataaaatacctctcagttgctgtgaataatggtctatagaagctgttcattgagaaaatgattattctcgagtttctgttgattttaaaccttttttgtctgtctctttcactagactgtaagcttcttcagatcaggggacatgtcttgacagtctttgtattcctgttgtttagcatagtactggcacatcataggtgtgcaagataagaaaatgagattggaagaatttatgctacttcgtgcgcctaacaaatgtggatgtctgtattatactgatactatattttcaatagttagcaaagaaggccatttaatattttaatactgaaaagcagaattgtgctcattttattcaatacttaccatataccatacactagatagtaggtggatgtaaagatgcagttcctgctctcaaagaggattatgacctagaaaaggttacagattggattgagataactttataggcctgaacaatacagaaaagatttctaaatcattgaagacttcagggaggaaaagagattgaatgcgtcggcaatttttatcattcccgttactttgaacaatagtgtatgtaagtgcaaaaaaaaagaaaaagttgctgatcattgtggtgagaggaatgtaaaatatgagtatttttcttgctgctaggtttagttatattgtgctgcttattcttaattctagtcctaacaaatttgatttcaaaagcacatctgtggtcaaccaacttcattgttaatatttgttttattcatattaagtgacaatgtaagaatattcatgttaagtggtactgcagattttataaaaaggagaggatccaaaaataaaaaagtattttgctgatttccaactcccatccctctttttcaggaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaataaaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctatttttttttttttttttggttgttgttaaacagaaccttaagtttatgtttgaggtatgtactgcataggaacctattttattattaaagatgaatgattaaaattgg

SEQ ID NO: 61617 - DNA, 359 bp, Homo sapiens
tatcaggaagaaattcaagaacttaatgaagtcgcgagacatcggccacggtccacgttagttatgggaatccagcaagaaaacagacaaatcagagagttgcaacaagaaaacaaaggtaagatacgttactttttgacattaatcccatttctagtctatattcctaaatcgtatttattgctctttatcctgtcccacatatgaacatctgcctggttgacatcctcttagattctcacccttaatatccagttagcactgctgttgttagctatgaaataacccagcttcattctctgcagtcccactgcattggcccccagattagatgctcagtctcttgcctgaaatgtcca

SEQ ID NO: 61618 - DNA, 2906 bp, Homo sapiens
agggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaaggaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaataaaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctatttttttttttttttttggttgttgttaaacagaaccttaagtttatgtttgaggtatgtactgcataggaacctattttattattaaagatgaatgattaaaattgg

SEQ ID NO: 61619 - DNA, 3373 bp, Homo sapiens
agggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaaatgagttgcacaattgagaaggcacttgccgacgctaaagctcttgttgaaagattaagagatcatgacgatgcagcagaatctctgattgagcaaaccacagctctcaacaagcgagtagaagccatgaaacagtatcaggaagaaattcaagaacttaatgaagtcgcgagacatcggccacggtccacgttagttatgggaatccagcaagaaaacagacaaatcagagagttgcaacaagaaaacaaagaattacgtacatctctggaagaacatcagtcggccttggaacttataatgagcaagtaccgagaacaaatgtttagattgctaatggctagcaaaaaagatgatccgggtataataatgaagttaaaagagcagcactccaagattgacatggtacatcgtaacaagtccgaaggattcttccttgatgcatctcgacacatccttgaagcacctcaacatggactggagagaaggcacttggaagcaaatcagaatgaactgcaagcacatgttgaccagataactgaaatggcagcagtaatgaggaaagccattgaaattgacgagcaacagggttgcaaggaacaagaacgaatatttcaacttgaacaagaaaacaaaggcttgagagagatccttcaaataactcgagaatcatttttgaacctaaggaaagatgatgcgtcggaaagtacttctttgtcagcattagtgaccaacagtgatttgagtctgaggaagagctgaagagtttctgagtctgtgagcttcttacatggctccaaatggtcaaataagtgaatgaatgaatggacagaaaattcaatcctttatttttttctctgtaaatatgtacagtgcacgggctatgagatagcaacaaaaaatgcatagttaatggtcatagactttattccaaaacataattggaaaatagaaactgagccattgccaaatggtaaagaaatgaaaagttttcacagtgactactgaatataccaagagcttttggcagtactgctggctttctgggtgattaattaggtaaacttgaatattcccagtaaatgtttgagaatgcataaaattataccaatttaaaaatataaatttttgccactgttttgtgaacggaggatttgtacgctaaatttcatccttatttggcgtcaaagttgatgcaaagtttatgtaccatgagacttctagtgattgcctactttcacatttatttaaatttttgtgaaagaaaatacagttttaaaggctataggaatgtgttatatgtaccttaaacagataatttaattttagcaatttatcataactgatacttagctaacaattgtccataacttgtttaagtgtaagaaataccatttcaggaatgaaaaagaaggaatactactttctaagaaagaagatcttataatagacatatttagtaggttaaactactcctttgaaagaataagttttggttcaaagtcaataatgaagacgagatttgtttttctcttctctggctgatttttaaggatattatgtagttcatttagttaacagaattgaaatgtttgatatggcaagataggtatggtaatttcaaagtgaattgggaattcctctggctcatagaacccttttttttttcctttaagtattcttgagatacaaaaaaaaaaagtaaataaaatttcaaaaaaaaagttccggatctgtttttaagctccatctggtcctcataacctgcaagatttttcttaaaacctttcagctgaaagtgggggtaaaggtggagtaatctgtggatttgtttctgttgtcttttaaaatgtcaaatatataatatgtaatttttttaaaaaccaccagatacagaaatgtgctttaacatcagttgaaacctaaattttcttatgttgtggtgattgtattaaaaagggataaaagaagagtgtcaaacatggttaaatatattgtactcatttatgttgaatacgtattaaaattaagacaaatggaaaattatactttgagtatataatttgttaaatattactttatatggtaattttatgtataatttcatatattggtaaaattcaaaactacacttgagaatttttttatcttaagtttggggtgaatggggtggatgagactgattgaatagaaaagggctaatggcccaaacattatatagatttctttttttcagtcagaggccttatttgatattttataaataaatgacagtttttatttttaaactttttattgtttttgggaaagtattccttaatttaatgacacattcattcagatacttcttatccctgctaataaaggaaatctatttcaagctacaccattgagattaagtctgaggcagttcattgaggcagctctactataaaagcttacttgataaataattatttttgtaaacaagttgggttaacttattcttcgtctttttgcttggatatgaatttaaggtcttcatgtttaaagacatttactttgttatttagtgacacatttccatcctatttttttttttttttttggttgttgttaaacagaaccttaagtttatgtttgaggtatgtactgcataggaacctattttattattaaagatgaatgattaaaattggaaaaaaaaaaaaacaaaaaaaaaaaaaaaaaaaaaaaaaaaaacaaaaaaacaaaaaaagggggggggcggtcaaaaaacacccccgaggaggggcacccaacatgatggaggtacgcacacccacatttcctgtgaaaaacaaaaggggcccaccaaaaggagaggcatcaatacaaaagaacgagagaggggcgagcagcattaaaaaacagagcgcaggtgcgcgggaaaaaacaggtcgcgtcgtgggcaatttccgtgggggaaacaacccccccatccgcggggggggggagcaaactggggcggcacacgcccccagaaaaaatacacggcgcgacggggaaaaac

SEQ ID NO: 61620 - DNA, 1436 bp, Homo sapiens
agacgggtgatctagaggatcccgtctagccgtgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggtaccagggcatggcggcggtggtggggttgtcgggggtggccaggagaatggagtcagggtggggccaggtgacggcaccatggtcgactctaaagaactgggtatgaggggtcggggtggggagatcccagagttgctccagaagattccaaaaggggagggaagagcagcagcaaggacctctgagaaagaggatggggtcaaccattaccccaatttctccaaaggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacaggcagcaaagatggttacaagcttccctggacgtgggacacaccatcaggaaggggcctggctgaggggacccctaccgcaggcaaactaggaccaactcttggggctggcaccaccaggagcccaggcagtcctccaactccgagagtccatggagacacaggttccccgaagaaaaaccgtggccccgagcgccggccaccgcggcccgctgcga

SEQ ID NO: 61621 - DNA, 1721 bp, Homo sapiens
gacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggtaccagggcatggcggcggtggtggggttgtcgggggtggccaggagaatggagtcagggtggggccaggtgacggcaccatggtcgactctaaagaactgggtatgaggggtcggggtggggagatcccagagttgctccagaagattccaaaaggggagggaagagcagcagcaaggacctctgagaaagaggatggggtcaaccattaccccaatttctccaaaggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacaggcagcaaagatggttacaagcttccctggacgtgggacacaccatcaggaaggggcctggctgaggggacccctaccgcaggcaaactaggaccaactcttggggctggcaccaccaggagcccaggcagtcctccaactccgagagtccatggagacacaggttccccgaagaaaaaccgtggccccgagcgccggccaccgcggcccgctgcga

SEQ ID NO: 61622 - DNA, 465 bp, Homo sapiens
ggacacaccatcaggaaggggcctggctgaggggacccctaccgcaggcaaactaggaccaactcttggggctggcaccaccaggagcccaggcagtcctccaactccgagagtccatggagacacaggtgagacacgtggctggggtgaggagactgggacggtatttgtcctggggtaaagagacagattccagactccccactggaacccttaccccagaaagactcagcagaaatataccctaaaacaaagggttatcggctgagcatggtggctcatgcctgtaatcacagcactttgggaggccgagttgggaggattgcttaagctcgggagtttgagagcagcctgggcaacatggtgagccccccaagatatgaacattagctgggtgtggtggtacgcacgtgtggtcccagctgcttgggaggctgaggcaggaggatcccttgagcctgggtg

SEQ ID NO: 61623 - DNA, 1848 bp, Homo sapiens
cccagggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggtaccagggcatggcggcggtggtggggttgtcgggggtggccaggagaatggagtcagggtggggccaggtgacggcaccatggtcgactctaaagaactgggtatgaggggtcggggtggggagatcccagagttgctccagaagattccaaaaggggagggaagagcagcagcaaggacctctgagaaagaggatggggtcaaccattaccccaatttctccaaaggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacaggcagcaaagatggttacaagcttccctggacgtgggacacaccatcaggaaggggcctggctgaggggacccctaccgcaggcaaactaggaccaactcttggggctggcaccaccaggagcccaggcagtcctccaactccgagagtccatggagacacaggttccccgaagaaaaaccgtggccccgagcgccggccaccgcggcccgctgcga

SEQ ID NO: 61624 - DNA, 1207 bp, Homo sapiens
agacgggtgatctagaggatcccgtctagccgtgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacaggcagcaaagatggttacaagcttccctggacgtgggacacaccatcaggaaggggcctggctgaggggacccctaccgcaggcaaactaggaccaactcttggggctggcaccaccaggagcccaggcagtcctccaactccgagagtccatggagacacaggttccccgaagaaaaaccgtggccccgagcgccggccaccgcggcccgctgcga

SEQ ID NO: 61625 - DNA, 511 bp, Homo sapiens
aagctgctatatataactggtatcaatatgtttcaaggtgctacaggttgaatatcccttatccaaaatgttgggaccagaaatgttttggatttcagatttttttgggattttggaatatgtgcattagacttacaggttgagcgtctctaatccaaaacccaaaatgctctgatgagcatgtcttttgagcatcatattgatgttcaaaatctttcagattttggagtacttcagatttttgattttgggattaggaccacaatcttggctcttaattattccatatgatttttagttactttcttgtatttttacaagaatttctagaagtatcctcaggtgtcctttaccttcatgattcatggggaatgtaagttctatagagatactagcggccttttgtgagggactgtttgtgactttattctaagtcattttagagtatagttatgttggttgaaattttagaatatagttaatgttggttgaactccatcaaaacaaaaaa

SEQ ID NO: 61626 - DNA, 488 bp, Homo sapiens
ctcaaaaaaagaagttgagaactaccagtataaattaagaggagaagagggcatgggaccaaacactgaagcatataaatatttaagaaataatcttaaaagagtgaccaaataggtgaaaggaaatctagaatcatgtagtcaaggggtgacaatgttcaagaatatgggtattggcagttatgtcaaatatttccagaagctcaaaataaaaggaaaatgaacttaccttcaggtggttattgtgaccttgtcaagagcaatttaaaatgaactggttggaacagaaatcttcatgctgaggggtaaatgagaggtgagagagaagaccatcaaactttaaaataagaaaatccattttttaagctaatttcaaggttaataaccataatttattctgtgtttttcaaaataggttaattaactttcaccctttcttgtacccattctcctttcatttaccttggaaaccctgtttttttcttctt

SEQ ID NO: 61627 - DNA, 1938 bp, Homo sapiens
  misc_feature (1263)..(1263): n is a, c, g, or t
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttaggtagggttgacaaacttgcattagctgaaccagggcagtatcgatgccactcccctccaaaggtgagacgtgagaaccatctgccagtcacttacgcataaacccccaagctcacagccagctcctggctccctaaccccacggttccacacggctgtgtggcagctgcaacagtggtgtggttccgtcatgaattcttctcaaagatttgacatgctccactccggtaactttggtgagttgagagctttcttgtttgttttccctcctttaccanccagaaatccatttgagtctgctccttgtggttaaggactggcgtttgcagggaggtgcggactctcctgcggggctcacgggaaactcttccctcttcgtgcgacaggcatttaggggcgtgcctgccatgggcaaagccatggtgtgtgttcagctcttggcctgtgttgtaaacttagttgcacttcagttcctttcatcccttcacaaaattttgtttcacattcatgcagcaaatatgggctgaggtgccagacctgtacctgggcttggtgcgtttcaaatttcagaccagttctttgggctgggtcaaggcaaagctcagtcgtcccagcagcacctcagccatctgtagaaggttctaccattaccacggtttcagcttcctctaaacttctcacccgcttctcctggcaatctgtcagaacggtgtcatcctggggaagagaaggagcttgggtgcatttgccctcatcctgagaaggccagaatactggagaccagcgtgaaccctcacccagagtcaggggaagatttagaaacagtgacacctgcatatagaattttgattccttgaagagcctatttagttccataaaattggagaactgctgaaggtcagtaattccgactttctcagcagtggtgtctctgaattactgcaaagggtaaa

SEQ ID NO: 61628 - DNA, 722 bp, Homo sapiens
tttgcttttatagaggcagtagattccaatgtatatctgcttaagccatcagcaaaaaactaataggcttactacaatttctttggaaaaacctgcttctggcttcagcctcacttcctttgttctacatcccagaagatgcacgtgagggcagctgcctggtaactggaggcttcacttgaccagcactgagcttctgttcactcattcaggtctcacatccatgtcatctccaggactcaccgaaaatagtcagagggatccctgtaggtggaactttattttctgtttttcctttgctgctttcctttgaaatgtttatttccatgcctggatacattgctgtatttgcatggtatgcagatgatatattattaaaaagcagaaattaaatttcaacttgacttgaacctacaagtagtacatttttatgagagcattattagttctttctattaccaacaagtaataattactaaattaatacctaaaataagtttaaaatgttgcatggaaatgtaggacttttttttttttttacaatatgtgtcttttcatgcatcaggtgaaattaatcaaactgacattttttatgaagcaatatttgtattaaaagataaatataaaataccaggaaaataatactagctatttgaataatgaggctggtacagctccataaaactaattcggcatcccttgctgctagtatgttcattttc

SEQ ID NO: 61629 - DNA, 1414 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61630 - DNA, 1437 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtcgggatgcggccagttttttgtttttgggaaaactataaaccgctcgcccca

SEQ ID NO: 61631 - DNA, 1363 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61632 - DNA, 860 bp, Homo sapiens
agatagagtcctttctctccatgtgtagggttggcgtctctcacatgaggatcttgtgtcctgcttcaggagaaaatgagaagatccttcctaggttttatgcctgcctcaggggagaagggcaaggggaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61633 - DNA, 1530 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggtcactttcagctgacaaaccactggactgtcagtgtgtgccattagcctgtcacctggtggagaaacaactcatctccaagtgatgtcagtctcccagtagacccggacctctagtgcctgatgttcactttcttcaggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61634 - DNA, 1219 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61635 - DNA, 1242 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggtcactttcagctgacaaaccactggactgtcagtgtgtgccattagcctgtcacctggtggagaaacaactcatctccaagtgatgtcagtctcccagtagacccggacctctagtgcctgatgttcactttcttcaggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61636 - DNA, 994 bp, Homo sapiens
tttgcttttatagaggcagtagattccaatgtatatctgcttaagccatcagcaaaaaactaataggcttactacaatttctttggaaaaacctgcttctggcttcagcctcacttcctttgttctacatcccagaagatgcacgtgagggcagctgcctggtaactggaggcttcacttgaccagcactgagcttctgttcactcattcaggtctcacatccatgtcatctccaggactcaccgaaaatagtcagagggatccctctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61637 - DNA, 1449 bp, Homo sapiens
  misc_feature (1403)..(1403): n is a, c, g, or t
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtagatttcgcgccgaaacnttctccttcctttataatttcggtgcgaaaacgagggatgaaacaa

SEQ ID NO: 61638 - DNA, 1309 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61639 - DNA, 1459 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccagttggctaaatcaagaacagttttaataagtgtttcttttgggcaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61640 - DNA, 1380 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagcctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61641 - DNA, 1126 bp, Homo sapiens
gaacgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaaaaaaaaaagcacaga

SEQ ID NO: 61642 - DNA, 619 bp, Homo sapiens
gaccggagggaagactggaagttaagcagccatcatgctccactgaggaagtgagggtgactggagccaagagatgtggagggagaaactggttccaggaaacaccctctattccctgtcgcttcatgctgcgagttacaggggttattcaaaagcacactggagaaagcaggaagagcgccacctacagcttgggtaggctccatttcgaggatggaatcaatccactgtggctccgaggcctgcctcctgcttgcgacagttaaatgccttcggtttttgagttatttaaagaacataccattttatgggcaggaggaagcactttaatctgcaaaatgatttttatcacaaactaaacatccttgtaactttttggtcctctgctttggtcaaagttgtctctccttggagctcagacagctgttggagctcagaagatctgcctccaccctgcactttgccctgctcgctggtactctggtgctctccaattcctggatccatgtgggatgtaagaactcaggatcaggacgcctgcacgcatcaaaatggggcattttctttctctttatcccaggacttgagagaaagcaaaaaacaaacaaacacaaacaaa

SEQ ID NO: 61643 - DNA, 213 bp, Homo sapiens
agccaaactcacaggagcctaggcacagagcgctgaacactggctctggcagcgggaaggaattagagcgcttctgcttttgcacctgctttgcagttaggaagcaagctctcttccttgccagacttccctttggggcaggacacttttcttatattcttgaggcaaggcaaacagtcataggacagttattaaacaattataaaatgtgtt

SEQ ID NO: 61644 - DNA, 238 bp, Homo sapiens
atctcacagattctttttcacagattcattcatgttgagtgaaagaagccagatgcaagagtccacaccacatgattctgtttctatacaacttaatttgaaaactaagcaatacttacagaagtgagaatagtagttgtctcagggtaggtgagtgcatgaaggaatcttatacgtttgctaaaaatgttttatatcttgatttgggctatggctgcagggaaggatacattgcaaa

SEQ ID NO: 61645 - DNA, 1340 bp, Homo sapiens
cccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgcgagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggagaacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaaaaaaaaaaat

SEQ ID NO: 61646 - DNA, 3232 bp, Homo sapiens
ccggtccggaattcccgggcgaggcggcagctgcgcggcggcaccggggcggctgcggcgcgctcggagccccgagggcacgcggcccgggcagctcggtgtgcgcccccgcgagagccggggccccaggcccgccggacaccatgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggctccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgccgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 61647 - DNA, 316 bp, Homo sapiens
ggaagccaccttctctgtgtgtccccgcatgtgccagcctgggggggctgtgtcccacatatgccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 61648 - DNA, 3260 bp, Homo sapiens
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggctccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgccgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 61649 - DNA, 2702 bp, Homo sapiens
ctgaacagggagcctggtggtggaggcagtggtgggcgcagtgtgcccgggggctggagaatcccaccagggaggccttgacctccccaaggcagggagaccttcagggaaggaggctgcctggcatggcccctacccgcttcaggctggtgctggtgaggggtcctgtggccctgggcaggccattgtgctgcctgcctcttcacccactgtgcgggccttggcttccctgggctctgggtcatggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgccgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 61650 - DNA, 3616 bp, Homo sapiens
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggctccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgccgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaaaaaaaaaaaaaaacaaaaacaaacacaaaaaaaaacaaaaaaaaaaaaaagaggggggggcacaccaaaaaagacaaaccgcaggagggcgcccgagaattagcgacctgcaccatcatggtacaaaagcgggcgccccaatagagaaaggaaaaaaaaaaagaagacgagaggcccgggaaaccaagcgacgcaccggcgacaccgcgcaccaggagaattggaagagcaaccacccatgggggggggacaacgggagcacacacgcagagagatataagctacaaggaataacaacacacgtaatcgggtaacaccgacatcggcaggagaaagatcacaagtataacaattac

SEQ ID NO: 61651 - DNA, 1144 bp, Homo sapiens
acctacaggggaaggaggagtttgagaagacccagaaggtggacgtagtcatagtcctcctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 61652 - DNA, 290 bp, Homo sapiens
ctgaacagggagcctggtggtggaggcagtggtgggcgcagtgtgcccgggggctggagaatcccaccagggaggccttgacctccccaaggcagggagaccttcagggaaggaggctgcctggcatggcccctacccgcttcaggctggtgctggtgaggggtcctgtggccctgggcaggccattgtgctgcctgcctcttcacccactgtgcgggccttggcttccctgggctctgggtcatggtaagagcacctgggaggggagggctggccctggacccacttcc

SEQ ID NO: 61653 - DNA, 3167 bp, Homo sapiens
cacctggtagtgtcaggagagggcatgcactgccctggtgaggctcctctggctgcccccaggcccacacccaaggatccctgcctcagaaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggctccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgccgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 61654 - DNA, 1927 bp, Homo sapiens
ctaacaaaaaacattaaggctaagcaaaaaactcgatgataatacggaacgagggtcagactgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgccgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaa

SEQ ID NO: 61655 - DNA, 1520 bp, Homo sapiens
  misc_feature (1)..(2): n is a, c, g, or t
nnaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaacgtcc

SEQ ID NO: 61656 - DNA, 1841 bp, Homo sapiens
  misc_feature (1)..(2): n is a, c, g, or t
nnaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggtgagtgtcaggaaaggataaggctaatgaggagggggaaggagaggaggaacacccatgggctcccccatgtctccaggttccaagctgggggcctgacgtatctcaggcagcaccccctaactcttccgctctgtctcacagggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaacgtcc

SEQ ID NO: 61657 - DNA, 332 bp, Homo sapiens
aaggtctctgggaaatggggcattcccatattcttcctatcgtgtgtggtgaaagctgtgatcaggtggtttgggcccttctgagttggtgcgttagttacaaactgaggaaatgctgggggctgacagcatggacagggcccatacacaggcccggcaggctgcttgagccaactccatagcggccttttcctctaccaggggctcctgcaggccctggaagggatctcccccgagttgggtcccaccttggacacactgcagctggacgtcgccgactttgccaccaccatctggcagcaggtgagccttgttgggcagggtggccaagg

SEQ ID NO: 61658 - DNA, 1412 bp, Homo sapiens
  misc_feature (1)..(2): n is a, c, g, or t
nnaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaacgtcc

SEQ ID NO: 61659 - DNA, 305 bp, Homo sapiens
tcttctaaaatccataggaatccttgccttaggttacttgcacttgctgttatttctgcctaataaactccttctactaattattgcttgcctggatcatttggaacacaattcagctctcatcctccattaaattgtacctcactggcctagccatcactgtctgttatagtctctactattattcctcaatatttaccttttccatggttcctattgcaagataaaattcttttatgctcaaccttgacaagaatatatattctttctgtcttctttactacagtgccaagatcaatccctgg

SEQ ID NO: 61660 - DNA, 461 bp, Homo sapiens
gtgaaggatgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacagcaggaactcccagggatgaagattcctcctgtgacccgggctacctgtagccaaaatgcaactggatccagttaatcctctcatttctgacccactttttcctttgaaaatacaataaaattcccccataccggtgtgcatttaaa

SEQ ID NO: 61661 - DNA, 333 bp, Homo sapiens
ccttggccaaactttgttacatggctacctctgagtgcaagaaggctgggaaatggttgtttttaaaccaggaagattgctaacttgaaattgggttctgagtgggcagatcatgaagtcaggagatcaagaccaccctggctaacacagtgaaaccccgtctgtactgaaaatacaaaaaaaattagctgggtgtgatggtgcacgcctgtagtcccagctacttgggaggctgaggcaggagaattgcttgaatccggaaggcggaggttgcagtgagctgagatcgcaccactgcactccagcctgggcgacagagggagactccatctc

SEQ ID NO: 61662 - DNA, 499 bp, Homo sapiens
ctctccaccccccatccagacttctccagcaaacctttaaaatatggtcatttcctcagaatagaatccactctagctggtttaggcaaaagggattaaatttttttttcacagagcattaaaaggtttacaaatcacttgagagataaacagtctctaggttgagcatccaggagaaatgtccaaagccacaagacacaactgggcacctctgagaccagttgtctctgccatgataggaagtaccatagtggctgctggccacttacccagcagctactaccatcacagctcatgcttctctccccacttccttcagttctaaattcagttctcatgaatacatctctttggtagaacctgaatcatattcagaacagtaatttcattgaagtctgaaaagtgttagttttagctttccaggctcagctgtttaggaagaaagttgagatgatcactgaattgctaaaactacaggatcagccataataagcacaac

SEQ ID NO: 61663 - DNA, 681 bp, Homo sapiens
atgctagtcgaggcctgggtttaatcggccgagcgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61664 - DNA, 1704 bp, Homo sapiens
gctggtaccggccggaatttgggatggctggcgagcgcccgacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61665 - DNA, 2100 bp, Homo sapiens
cgccgggtccccggtacttgggagcgcggggcgcgcctcgagccggccggacgccgactccaactggggagagttttccgcgatgcccggacggagagcgggggcggcgccgcacctgcgcccgccctgcggaacggggacgccctggctcccgccaggctggggtcgcggcgcgggcttcggtgcccgcggcggggaccgggactttcggggcgagcgcagcgattaggcggcagcggcggggctccccgggctggcgggggctgctcagacccggagtctgctccatctgcagggtcgaggtctgggttgcgaccccgagcgcctctgcggcctgagcaggtcggggtggggcgtcccattgccggcggccgcggggcctggcgtgcgggcgcctccgcgccgcccggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61666 - DNA, 1686 bp, Homo sapiens
ggctggtacggtcggaatttgggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61667 - DNA, 1508 bp, Homo sapiens
cggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgcacacattcacacataaaacatcaagcgtgaaaacactcaatgatgcactcttttttgttgtttagtcctttt

SEQ ID NO: 61668 - DNA, 1541 bp, Homo sapiens
gaattcggggggagggggcagtgtcctccgagccgacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61669 - DNA, 1727 bp, Homo sapiens
cggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61670 - DNA, 2383 bp, Homo sapiens
cgccgggtccccggtacttgggagcgcggggcgcgcctcgagccggccggacgccgactccaactggggagagttttccgcgatgcccggacggagagcgggggcggcgccgcacctgcgcccgccctgcggaacggggacgccctggctcccgccaggctggggtcgcggcgcgggcttcggtgcccgcggcggggaccgggactttcggggcgagcgcagcgattaggcggcagcggcggggctccccgggctggcgggggctgctcagacccggagtctgctccatctgcagggtcgaggtctgggttgcgaccccgagcgcctctgcggcctgagcaggtcggggtggggcgtcccattgccggcggccgcggggcctggcgtgcgggcgcctccgcgccgcccggggagggggcagtgtcctccgagccaggtgaggcgagtaggaaatgctggatctggttaatgattcgccttgttccgggagtgcgagcgtggcaagaggaagctggtgaagtgggggaggatgcgtgctccggagggccgccaccccaggaatgtgtggctggcgggtggggctggcacaggagggtggggcccgtgcggaggggcggcagcccagccgtttctagggcaggccaagaggatgaggagaggaggaccagcctgcgataggagtaggcaggtcctgacccggtgcctgcgccctccccacagacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61671 - DNA, 1487 bp, Homo sapiens
cggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagctt

SEQ ID NO: 61672 - DNA, 1286 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaa

SEQ ID NO: 61673 - DNA, 532 bp, Homo sapiens
atggagcaggacctgcgatgttctgatggattatacccacagtgtattttggcacatctgccaaaagctacaaacaacccccaacaactacacactatatcttgtgagaagtgtcctacccaggagtcctgaatgtgatctgagtatgctctaaggcagccccaggaaaagcaattcagtccctctctctttgcctttagacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaa

SEQ ID NO: 61674 - DNA, 773 bp, Homo sapiens
ggtaccctccccgtacgcccataatgcagcaagtgaaggggtgttggccagcttcttcaacagtctgttgagtaaaaagacaggctctcctggaagtcctggtgctggtggggtgcagagcacagccaagaagtcaggtacagaagggccctggagacttgtgactcttgtggttgagtagtgcttcaaggatggagaggcagacacctgccctgcagaccctgcagtgtcctgaatagccaagcaaggaagcaggtcttcatttcctactgagcagtgtgccgtgctttcagtgggattgccttactaccatgcaggtttccttggcacattgagagtgggatttgtgtacatttgggttctcgggaactgggtgtgggtgagttgaggtatagcctaaattacatatgtggccctgttgtagaacctctccagtagaagtcatggtccatggagggtgtaccagtgactttttttttctttttccaaggtggagttttgctcttgttgcccaggctggagtgcaatgacgtgatctcactgcaacctccgcctcccaggttcaagcgattctcctgtctcagcctcccgagtagctgggattacaggcgcgtgccatcatgcccagctaattttttgtatttttagtagagatgtggtttcatcatgttggccaggctggtcttggaattcctgaccccaggtgatccctccatcttggcctcccaaagtgctgggattacaggtgtgagccaccgtctgcggctgacttt

SEQ ID NO: 61675 - DNA, 738 bp, Homo sapiens
ctcggctctaccttgtctgtccaggagctctcagggatttgggttgcctcctgcacagtcaaggagagtgtcactcaggctagtcatagatggcatacctacaggcttgggctgattttagatagttgttcagagcagtcaggcaggcgccagaggcacaagccctgtgagaggtgtgtttggaatcacttggtatccaaatcacatgtcatccctaggagcaaggagaccggttggatttggggctggtctggaatgaagaagcatctctcagcttccgaaggctgcatggctcacggcagtatctcaatcatgccctgcccgtttgcacatttggtcctgttggtagttacctctctggtgactggcaaagtcagcaaggatattggggtggagcaccctggctaagcaccctcttgattatagagctatggagtagaagacagatggagaatgagaggcctgtgagaacaatcagtcagttgccatctttcagagctgctcgagttcaaaagtgtgtcatacagggtattttaccattgctacctttaagggattcaggtgggaaccctaggctgtggcttcacataatggaacttgggtgccatcctaccctgtgatgttgagctggccagcactggtgtaggaacctcaaggactctgtgcttctctggtttggggcctaggataaacacaggccctgcttgccccttggttctaggacacatcttcccatgc

SEQ ID NO: 61676 - DNA, 509 bp, Homo sapiens
cggtgttggtggtgtgcacaaagtgtgatgcggtgagtgtcctggagaaggagcacgattacagggatgagcatttggactttatccagtcacacctgcggaggttctgccttcagtgtatcctttgggcgctgtgtggggcctgggtcacaggctttcttccaaatggggcatcttcaaagagataaagcacctcccaaacccagaatagtgttctgccaaagagaatttgtatatatctttttactaggtttatgttttactgtatcggagttttaggtttattaacttgtgtctacctttgatcactcatttatttgtttgtttgtttgtttgttttaagatggtgtttcaccactttggccaggctagtctcaaattcctgacctcaagtgatcacctacctcagcctccgaaagtgctgggattatagctgttagctactgcgctcggcgtattttttaattttttttctgagacagagtctgctctgtcacccaggctggagt

SEQ ID NO: 61677 - DNA, 4177 bp, Homo sapiens
ctctagaggatctctgctatcatcggcacccggcagaacattcggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61678 - DNA, 4094 bp, Homo sapiens
ccgttgggacctagcagcagcttcttctccacccccacccgcgccaggtccaagctgccgtccggcaagaacatcctggtcttcgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61679 - DNA, 3683 bp, Homo sapiens
gtatgcctatgtaatactataagcgttttagtttttaaaattgtaatgctttctgttgctcatatattgatcaaaaactgatcaacctatgagtagtactttgaggttgtatgtgttcgattttgtctcctcctgcagtgaattgatttttcttgagcagattgattagatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61680 - DNA, 3578 bp, Homo sapiens
atggagcaggacctgcgatgttctgatggattatacccacagtgtattttggcacatctgccaaaagctacaaacaacccccaacaactacacactatatcttgtgagaagtgtcctacccaggagtcctgaatgtgatctgagtatgctctaaggcagccccaggaaaagcaattcagtccctctctctttgcctttagacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61681 - DNA, 3096 bp, Homo sapiens
cccactgcatgcagaaacttggaatgtccactgcctgacattcactttccagagaggacctataaaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61682 - DNA, 3192 bp, Homo sapiens
tggcacaaaggcaccccccgccagagagcagtcaagtcactcccttggagttggaggaagcactggcctgtgacttttgggattaggatgtgccgagttggggtctcctcaccactgcagtagaaaagggctttcctcattcttattaaggttactgtcatcaagtgattatagaaggcgtataattttaaatgctcctttaaaaaaaattgtttcctcttctcacatcattactttgcttttttgctttttttttttttcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61683 - DNA, 2066 bp, Homo sapiens
ggaggtgttctagaggatcccgtctaatagtgtgtgggaagaagttattacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61684 - DNA, 1957 bp, Homo sapiens
cgggtgactctacaggatcttccaggtagacctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61685 - DNA, 2741 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttctgggaaaaaaagatgtctctaattactggcttcaataaacacgaatccagactgcttaca

SEQ ID NO: 61686 - DNA, 2851 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggcttaggtctacctggccaggtagacctaaccatggggctgtcccaatgcaccctacgtttcttcactgtaatgatcatcccacctggtctgcgtgccttcccagccggtcgtaagcatcatgaagacgaggactgtgatttgtttgcatttctatcccagtgtctagcacagagcaggcatgcagtaggcgctcggttttgtagatcaaattgggggcgctagacagggcccagaaacttgatgtaggtctacctgg

SEQ ID NO: 61687 - DNA, 1171 bp, Homo sapiens
atatactatctgtcgccttcgccgatgcagtcaccgacggcacaccgacatttgtgtggtggatctgcagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61688 - DNA, 1022 bp, Homo sapiens
  misc_feature (4)..(4): n is a, c, g, or t
  misc_feature (18)..(18): n is a, c, g, or t
  misc_feature (20)..(20): n is a, c, g, or t
tttnaacccctgcctgcncncgactctagaggatccccctttgctgaatacctgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61689 - DNA, 1649 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggagcgtgacatgatgctccccgctcccccggatcctctaaccag

SEQ ID NO: 61690 - DNA, 2039 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggtacagaagggccctggagacttgtgactcttgtggttgagtagtgcttcaaggatggagaggcagacacctgccctgcagaccctgcagtgtcctgaatagccaagcaaggaagcaggtcttcatttcctactgagcagtgtgccgtgctttcagtgggattgccttactaccatgcaggtttccttggcacattgagagtgggatttgtgtacatttgggttctcgggaactgggtgtgggtgagttgaggtatagcctaaattacatatgtggccctgttgtagaacctctccagtagaagtcatggtccatggagggtgtaccagtgactttttttttctttttccaaggtggagttttgctcttgttgcccaggctggagtgcaatgacgtgatctcactgcaacctccgcctcccaggttcaagcgattctcctgtctcagcctcccgagtagctgggattacaggcgcgtgccatcatgcccagctaattttttgtatttttagtagagatgtggtttcatcatgttggccaggctggtcttggaattcctgaccccaggtgatccctccatcttggcctcccaaagtgctgggattacaggtgtgagccaccgtctgcggctgacttt

SEQ ID NO: 61691 - DNA, 2588 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatgtgagttattttgagctgatgctttgaaactcttctttttaaagtacatttgctttttacattttaccccttcaaggaaggtgccttctgtctgtgtcttctacagccagctctctcactgcaccttctctctgttcctttccggattatgaggcatctgcctgagggaagtgggtggtgtggtcaggggtgctgcctttcttcctcgagagcaagttgccaaaacctaagccagccatttttggcactcactgtcaactctggtaaaatactggctggggagggaatatagggaattgtgcttgggggatcctgaatgtcttctattaaagcgcctgctttatctgtgtgttggcagggatgactgcaaacatcctctcggcatctctgtcagcatgggctttggctatattaagtgcttactgtgcttctggcatttcacattttgggagccaccgggattgattgtcctcgatagagacttggatacctgttttcctaagctggtgtctttctctcactggagaatcatagtgttgctggatgcataaatatgaagctgtggtctctgacaagacttgtgttagcagattgatgttcaggcttcagtatcctcctgacttaacaaacaattacattattcattcaggaaaccttattcagcacccactaggtgctcaggttctctgcaaaggacacagaaatgaatgatacgtgttccttgcatatggcactgtctagaggggacatacacagctgaagaagggaagggcagtgatggggttatggaggaagtatggcagggaaagcaggagggtgatgctggaagacaaatggtagatcccaggcggactggaaagaattgcaatagggggagccggggagtgcagtctgtgagaggctggaaatgtgaaagccaggagctctcagggatttgggttgcctcctgcacagtcaaggagagtgtcactcaggctagtcatagatggcatacctacaggcttgggctgattttagatagttgttcagagcagtcaggcaggcgccagaggcacaagccctgtgagaggtgtgtttggaatcacttggtatccaaatcacatgtcatccctaggagcaaggagaccggttggatttggggctggtctggaatgaagaagcatctctcagcttccgaaggctgcatggctcacggcagtatctcaatcatgccctgcccgtttgcacatttggtcctgttggtagttacctctctggtgactggcaaagtcagcaaggatattggggtggagcaccctggctaagcaccctcttgattatagagctatggagtagaagacagatggagaatgagaggcctgtgagaacaatcagtcagttgccatctttcagagctgctcgagttcaaaagtgtgtcatacagggtattttaccattgctacctttaagggattcaggtgggaaccctaggctgtggcttcacataatggaacttgggtgccatcctaccctgtgatgttgagctggccagcactggtgtaggaacctcaaggactctgtgcttctctggtttggggcctaggataaacacaggccctgcttgccccttggttctaggacacatcttcccatgc

SEQ ID NO: 61692 - DNA, 1939 bp, Homo sapiens
gtatgcctatgtaatactataagcgttttagtttttaaaattgtaatgctttctgttgctcatatattgatcaaaaactgatcaacctatgagtagtactttgaggttgtatgtgttcgattttgtctcctcctgcagtgaattgatttttcttgagcagattgattagatggagctgccttgatttacacatcagtgaaagaagagaaaaacctcgacttgttgtataagtatattgttcataaaacatacggtttccacttcaccacacctgccttagttgtggaaaaggatgccgtttttatgtgagttattttgagctgatgctttgaaactcttctttttaaagtacatttgctttttacattttaccccttcaaggaaggtgccttctgtctgtgtcttctacagccagctctctcactgcaccttctctctgttcctttccggattatgaggcatctgcctgagggaagtgggtggtgtggtcaggggtgctgcctttcttcctcgagagcaagttgccaaaacctaagccagccatttttggcactcactgtcaactctggtaaaatactggctggggagggaatatagggaattgtgcttgggggatcctgaatgtcttctattaaagcgcctgctttatctgtgtgttggcagggatgactgcaaacatcctctcggcatctctgtcagcatgggctttggctatattaagtgcttactgtgcttctggcatttcacattttgggagccaccgggattgattgtcctcgatagagacttggatacctgttttcctaagctggtgtctttctctcactggagaatcatagtgttgctggatgcataaatatgaagctgtggtctctgacaagacttgtgttagcagattgatgttcaggcttcagtatcctcctgacttaacaaacaattacattattcattcaggaaaccttattcagcacccactaggtgctcaggttctctgcaaaggacacagaaatgaatgatacgtgttccttgcatatggcactgtctagaggggacatacacagctgaagaagggaagggcagtgatggggttatggaggaagtatggcagggaaagcaggagggtgatgctggaagacaaatggtagatcccaggcggactggaaagaattgcaatagggggagccggggagtgcagtctgtgagaggctggaaatgtgaaagccaggagctctcagggatttgggttgcctcctgcacagtcaaggagagtgtcactcaggctagtcatagatggcatacctacaggcttgggctgattttagatagttgttcagagcagtcaggcaggcgccagaggcacaagccctgtgagaggtgtgtttggaatcacttggtatccaaatcacatgtcatccctaggagcaaggagaccggttggatttggggctggtctggaatgaagaagcatctctcagcttccgaaggctgcatggctcacggcagtatctcaatcatgccctgcccgtttgcacatttggtcctgttggtagttacctctctggtgactggcaaagtcagcaaggatattggggtggagcaccctggctaagcaccctcttgattatagagctatggagtagaagacagatggagaatgagaggcctgtgagaacaatcagtcagttgccatctttcagagctgctcgagttcaaaagtgtgtcatacagggtattttaccattgctacctttaagggattcaggtgggaaccctaggctgtggcttcacataatggaacttgggtgccatcctaccctgtgatgttgagctggccagcactggtgtaggaacctcaaggactctgtgcttctctggtttggggcctaggataaacacaggccctgcttgccccttggttctaggacacatcttcccatgc

SEQ ID NO: 61693 - DNA, 1368 bp, Homo sapiens
acacacctgaatgaataatgtaattgtttgttaagtcaggaggatcctgaatgtcttctattaaagcgcctgctttatctgtgtgttggcagggatgactgcaaacatcctctcggcatctctgtcagcatgggctttggctatattaagtgcttactgtgcttctggcatttcacattttgggagccaccgggattgattgtcctcgatagagacttggatacctgttttcctaagctggtgtctttctctcactggagaatcatagtgttgctggatgcataaatatgaagctgtggtctctgacaagacttgtgttagcagattgatgttcaggcttcagtatcctcctgacttaacaaacaattacattattcattcaggaaaccttattcagcacccactaggtgctcaggttctctgcaaaggacacagaaatgaatgatacgtgttccttgcatatggcactgtctagaggggacatacacagctgaagaagggaagggcagtgatggggttatggaggaagtatggcagggaaagcaggagggtgatgctggaagacaaatggtagatcccaggcggactggaaagaattgcaatagggggagccggggagtgcagtctgtgagaggctggaaatgtgaaagccaggagctctcagggatttgggttgcctcctgcacagtcaaggagagtgtcactcaggctagtcatagatggcatacctacaggcttgggctgattttagatagttgttcagagcagtcaggcaggcgccagaggcacaagccctgtgagaggtgtgtttggaatcacttggtatccaaatcacatgtcatccctaggagcaaggagaccggttggatttggggctggtctggaatgaagaagcatctctcagcttccgaaggctgcatggctcacggcagtatctcaatcatgccctgcccgtttgcacatttggtcctgttggtagttacctctctggtgactggcaaagtcagcaaggatattggggtggagcaccctggctaagcaccctcttgattatagagctatggagtagaagacagatggagaatgagaggcctgtgagaacaatcagtcagttgccatctttcagagctgctcgagttcaaaagtgtgtcatacagggtattttaccattgctacctttaagggattcaggtgggaaccctaggctgtggcttcacataatggaacttgggtgccatcctaccctgtgatgttgagctggccagcactggtgtaggaacctcaaggactctgtgcttctctggtttggggcctaggataaacacaggccctgcttgccccttggttctaggacacatcttcccatgc

SEQ ID NO: 61694 - DNA, 396 bp, Homo sapiens
tagaacctgccagacttaaaaatgccagttggctacatgctgcggctggttttgggagaggtctgtgccaggctagaaaaatattactctgcagtctcagtagggatctcccagacctgtgttgaagcctgagcctcggactctcctttcggcatgaagtttgacagtggttaggagtattcttggcctgtggccacaaacatgtatgttgtttcacagctggtccacgacaaagagttggcagcagaagatgagcaggtgttcctaatgaagcaacaggtaagaagaccagtgaggttagaacagaggccttctcatgcatgaaatgccagtccctagggtggggttgggggtgtctgcatgtgggaagtcacaaagagcttgcagtggtagagg

SEQ ID NO: 61695 - DNA, 759 bp, Homo sapiens
  misc_feature (752)..(752): n is a, c, g, or t
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtaatccgttaatgtcccggaaaaagngcacaat

SEQ ID NO: 61696 - DNA, 4332 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61697 - DNA, 4390 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttacaaaaaacaacaaaaaacaaaaagtcgagcggccgcgaatttagtagtagtaggcgccgc

SEQ ID NO: 61698 - DNA, 4881 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttacaaaaaaaaacaaacaaaacaaaaaaaacaaaaacaaaaaacacacaacacaaaacaaacaaaaaccacacaaacacacacaacaaagaaagtaaaagaaacacaacacacaaaaaaaacgaaagctcacacacaactatactagatccagaaaacaggaaggaggagcagccagaggcggcacaacctacaagaggagaccgaacatcaagcagacacaacgcgcacgagtacacagacaagtgatgagagcttaccgaattgaggccagtacaggaacacgccagggcggataaggcaagacaagaataagaagcggcgcgagagcaggggaacggcaacaggacgaacaaagaaaagagggaagtcagaacgagagagaagaaggaccgaacccggtgatcaagaagcaggcgcaaagccgagcggcgagaccgacagcccgacaagaagaacaagagagaggacaacgagcgccgacagaccaatcacaaacatcaggccgatgtgtgtcgagaacacaaaacaagcagacaggagtaggccgcaag

SEQ ID NO: 61699 - DNA, 3487 bp, Homo sapiens
agcgtgtcctacccagagagctctgaaatgtgatctgacatatgcatctagtgcagtcgccagcactatggcccttcgacgcctctctcttgtggccttagtagcttggctgctgggcggacggtggaggggatccttcatctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttaca

SEQ ID NO: 61700 - DNA, 2368 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctttgctgtggaaggaccggcat

SEQ ID NO: 61701 - DNA, 1638 bp, Homo sapiens
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagaggaccctctggctctccaaggacccagggtcggggagggccagccagtgtgcctagctcctccccaggcacgtcagtaaaaaagccggacccaaacatcaaaaataatgcagcaagtgaaggggtgttggccagcttcttcaacagtctgttgagtaaaaagacaggctctcctggaagtcctggtgctggtggggtgcagagcacagccaagaagtcaggacaaaagactgtgttgtcaaatgttcaggaagaactggatagaatgactcgaaagccagactctatggtaacaaactcttcaacagaaaatgaagcctgaaaacatatccagagtcagactctccagcgacacgtcagctgggaaactcagcagggaaagcgggaagtaaaaatagctccgccagccgaccctcggagccttgtcccaggctgggccttgggcttgggtccagg

SEQ ID NO: 61702 - DNA, 1214 bp, Homo sapiens
  misc_feature (1195)..(1195): n is a, c, g, or t
agcgggtggggctgcagttggcaagatggcgccggtgggggtggagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaagtgtgatgcggtgagtgtcctggagaaggagcacgattacagggatgagcatttggactttatccagtcacacctgcggaggttctgccttcagtatggagctgccttgatttacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctattttacatgaaaattttacaaccgtgaagccggaagatgcatatgaagactttattgtgaaacctcccgtgagaaagctggtccacgacaaagagttggcagcagaagatgagcaggtgttcctaatgaagcaacagtcactccttgccaagcaaccagccactcccacgagagcttctgaatctcctgcaagagaccctgggtcnttggagagccaggtcgacg

SEQ ID NO: 61703 - DNA, 623 bp, Homo sapiens
aagaagacacttgcaaagccgctaagacaggaccacacatcttaaactgctgttcctaccatgcactaaactgtttttaagttttaaaccacaccctaggctccaggagtgttcaggaaagatggtgtttgtaggtctccatgctgtttggcgttggggggtgtggagggatcatccgtcgactttctgaattttaatgtattcacttagtaacaaaccatgattgtcttaaatgccttaaattattatgagatttcttgtctcagagcccaatcagattgtcaggaattaacatgtgttaggtttgatcacccttgaccacttcttatagatatttcttcaacaaatcatgtgtgatgcctgtaggaacacaactgtacctttaaaatattgttttcatattgctgtgatggggattcgaggttcctgtatgtgccactgttttcagaatctgtagttttatacaggtgccgaccctcgttgtgatgtatgtgctgtgcacattgacatgctgaccgacaatgataagcgtttatcgtgtataaaaagacaccactggactggatgtacacaactgggaaaggaattaaaagctattaaaattgtgccttgaaatgccaaaa

SEQ ID NO: 61704 - DNA, 406 bp, Homo sapiens
aagaactcaaagagtccaaagttgacttaaaggaaataaagaataataacatttcttgtatacccagagccctaaaaggagttatggtcccactatattctgcagagtttctgtgagtatttaacatgtaagataattcatgtgaaaggcccctgcacatggtggacacttaatattttccaaatcaaatgatatcatttcaaaattggcagctgcagaaggggctgaagaacctaatttcttgcaccccatttcatcctacctgagtgaacatcagttggtccataagaagagagcctaagctcctcccaggtacagttagaaaggggaggtgaaagggtccagctttttcaagacatggtatttgatgttatttaacaggaaggtagaggtcaagcttggcaga

SEQ ID NO: 61705 - DNA, 282 bp, Homo sapiens
gaaaaggctatttgagttcatcggtccttctttctccctgacccacatctgcttcctcaagcaaggcaggacagtctgaaagaactgtatattagcaaggatttataatgtatgagcatttttaaaaagactaaaaatttaccttggatcaaacaagggaaagcgagaaagagaacaatgcaatatgtaattaagaaaaggaatgcctacaggaacaattctgatgattttggcatagcaccaaataattggaggaaaaaaaaagaaaccaagaaatatgca

SEQ ID NO: 61706 - DNA, 856 bp, Homo sapiens
agcgagggcggggaccgctgcgcctacctgcctttccctccatagggacttcccaaaggaaaggagggcgtttaggggctttcacacgcctgatcttaaacacagcgccctgacccctccccaccaaaaacggcaaaatgtcatttttgggggcaaatctaaggttttccctacaattgttcaagctttcacactaaaacatttacctaaaaacgggcagaaattcagccttaaacccacaaatctcacgatggtatagaccctgggcccactcaggtttcctgaaaactaaacagttctggagttaggggtttggagaacgggctattgttaaagaaaaaagtatttagtgacacttgttaaagcacaaaaagagggctttattcaggaccatcgcaacaggtatagggaccactgactgcaatggagacttgcagtagggaaagagatattgggctcaactcctcatacagcatgggcaagtggagatttatagccaaggagcggtgacaggccaagataatgaggcatcacctgggggatggtggagactgaagaacctgatcagatattgaggatgatcagctatcaaggatgggggtttattgctaatctgacttagcaaagttctttgcttaaactggattttacaaagaaagtgtacagaagagcctagcagaagattcagaaacctgactaaagttggccaagcaaaaaaaaaaatctttgtatctgaagggatatgttatcctctggacaaattgagggggactgtgcgttaacaatcttagcagtcctcttcagttgtaccaccatctccactttaataaaaaaaaattttctttcaaatctggcc

SEQ ID NO: 61707 - DNA, 730 bp, Homo sapiens
atactttgtgtagagatgaggtcttgccctgttgcctaagctggtctcaaactcctggactcaagctgtctgcccacctcagcctcccaaagtgtttggattacaggcttgaggcactacacccgatccccataaccatttcttttgctgctgtttaatctgctatgaatcctatccagtgaattttcattttggattttgtgggtttttttccccctggaaattatgtttgggtatatatatatatattttgtttttctcctcattatgttcatgtattcctcttaaccagcccctctcaactggttttgcagaacattgagccctgaattaacacacaacagatacggcattagggcccaatttgcatctggaaaatttgcattgtacgtttgcatctagaatgcacagccatgtaccatccttgggaaaataaagaaaatagttcctcaaataactttctgtggggctcaattctcttacagaactgtgattgagaaagactgctttgaatatttgaatgtagttataatagctgttttgagtctttgctgattctattgcttgtataatttttggatttgtttctactgactgatttttctctagttataggtcacattttttttgttttttcacatgccaagtaagttttggttggatgaaggacattgtgtattttatgttgttgggtatctagattttgttggcgtctttgttgggtttcgtt

SEQ ID NO: 61708 - DNA, 411 bp, Homo sapiens
gtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataag

SEQ ID NO: 61709 - DNA, 328 bp, Homo sapiens
ccatccattttctgaatgaagagagggaggagggggtgggaccctcgaattttttaatgctcccaaaataactgagtgaggaacttctggcccatttcacagaagagggagaaaaaaaaaaagactcagacaagtaagggaatagatgttgggtgaaaagggaagtgtgttctcgggccttggctaccagggccaaattttaagcatggatcagggcgatttcactttgtgccttagaggtggtggacctgcgtggctgcagaagtggtgaggagcttgttgcacagatgctagaccccagggccagccccagccctgctcatccact

SEQ ID NO: 61710 - DNA, 510 bp, Homo sapiens
gcctaaggcagagttataaactgcatgcctgagcatgtaaggcctgtggccctcacacacatacacagagcccctcagtaaagtataagaaactcatttggtacaggcatttaaggaattggtataaagtatggttctctgacccacaatggaatgaaattataaataacaaaaggaaatgttgggaattcacagataggtggaaattatacaatatacttctaaataaccaaagaatcaaagaagatacttcaaaggagagtagaaaatattttgagatgaatgaaaatgaaaacagcatatccaaacttatgagaggcagctatagcaatgcttacagggaaatttataactataaacatttatattatttaatagaaaataagaaatctcaaatcaataacctaaccttacattttaggaaagtagaaaaagaagagaaaactaaacctaaagcaagcagaataaaataaataacagagattggaggggaaataaatgagataatag

SEQ ID NO: 61711 - DNA, 366 bp, Homo sapiens
ttccatttttgctccttctcaggataatagcagaccggtgatcacaactttagttttgatgagataacctccttatctcctaaaaatggtctctattattttccaagagaagaccagtaaacactaaacacctgccttgatctcagtgtcttagatgttttcctgtttctcctttatcctagcaaactccccaggttgctattcttattcccattttatagatgggcaactgggtaagagaggtaagcttggtgaggtcactgagatagtggggaaaggagcttggttcacatcaggtatgcattcccccaaggttccactggggcatctgaagaagggtttctggaagtgcaaatataggtactg

SEQ ID NO: 61712 - DNA, 312 bp, Homo sapiens
atgggcttccactgaaatggaagaaaagacaacagacaagtgtatgtaatttagaggaaaaagaggcatgtgctgtaaagatattatcagtaccctcagcacttgatcagcaggtctccatatgaccaaattcagaataatccagatataaacttgtctgattctgggaattcatatatatttaagataacacttcactctaatttggaaagttttgactgactcctagaatcgatgtgttgcggatgttttaaaaagcctttggttttggacccatcagctagtctcttcccttccccatcatactgtctg

SEQ ID NO: 61713 - DNA, 434 bp, Homo sapiens
cttgctgtgggacgaggatctcacatgtcctcagtgaacttgttctgatgcaggcagatgagcagctcttaatctgcctgaactctcaagtccccatttttttttctaaacaacagcaacagaagccaatttagcaataacccgcggcactggggctgcacataagttttgtccccaaatcctacttctgaaagtttattttgcgatatgacctcactagttacacagaacctgaacatgtcctcagcagcactgcatgtgatagttagaaaggacatgtaaaatattcttaaatatgatatgtattagataaattatacaactgctaaaaaagaatgaggcagaaaatgtgttggacacagaaaagctaacagtaagtgaaaaaggtgagctgtagcatgttgtatatgatatcgtatgtaatatatgtgttg

SEQ ID NO: 61714 - DNA, 814 bp, Homo sapiens
tacatacacttacgtagtcaactttgaattttttacatattaatgaattatttatcccaaactgcctgccctctgccaccagccagctttcatattagacattataatattgctctcaatccatgaagtgggaattttttttcatatttcattaaatgtagagataatgtctactttacagtagagagaaaagtctattttacagagaaaaatgctttccaaagtcaagtgtcagtaatacttggatgaccactgcagtatgtttttcctctgacattgctaaccttatatcacttctgttggctaatagcatagcacccttaggcactcagtaaatcattattaatgacatgctcttgagtttaagagtccattttttaggaataggaggaagagcaaagtgccttggcaacctttgacttcaaatgccttttacatggctgatatcttacctcttttaaaaaaaaaaaaaaaaaagttcttgctctaaccacaaacctttaatttctggctattatagtgttttattgctctcctagctatttacttaatggtaacagtagtaataatggctatcttttaatggtaatgggagcgcttagtttttgaccacttactgagtgctaagctctgttgttgagctcttcactgacactattttatcctcactatactgtgcaaagtaggtactattatcccatttaacatatgggaaactgaacttttgagtggtaaaataacttggtgacagtcacacagccagcaagaagttaagtctggatttcagagactaggcccttaacccgttacattt

SEQ ID NO: 61715 - DNA, 226 bp, Homo sapiens
cacacatcacagtcgtaacattcacacgcattcacacgcacgcattcacactcacattcacacacatctacacactcacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61716 - DNA, 3676 bp, Homo sapiens
gggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61717 - DNA, 3378 bp, Homo sapiens
aattccgggtcgaccccctcgtgcggaaatgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61718 - DNA, 3446 bp, Homo sapiens
aattccgggtcgaccccctcgtgcggaaatgcggcgtgagcagcggcccgaggctcccggagcatcgcgctgggagaagacttcgccgctcggggccgcagcctgtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61719 - DNA, 3997 bp, Homo sapiens
  misc_feature (3786)..(3786): n is a, c, g, or t
gggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaacacaaaaaaacatataaanaaaaatataaaaatataatgaaaaaaattttttgggggggggcccggtacccaacttgccttatccgaggtgaattccccatccaccgggcccgctttccacaactggcggcttggaaaaccggggctgcccaaacttttatccctctagacgaaaaccccttttgcccaatgggcaaatttgccagagggccccccccgaaaaacttttc

SEQ ID NO: 61720 - DNA, 3552 bp, Homo sapiens
gggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61721 - DNA, 3979 bp, Homo sapiens
aattccgggtcgaccccctcgtgcggaaatgcggcgtgagcagcggcccgaggctcccggagcatcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaatatatatcttttttttttttaatttgccctgtcatctttgggggctgtctcccatgtcgtgattttgacgtgatctctccgtgacatcaccgcgccatcgtgaagtgtgatctcatcgccgccctgtcgtgacttcatcaatgtcgtgttgtgacctggctgcggcgggacaggtggtgaccgccaggaaccctcctccccttctcatctccccatctcagcagccctgcttcgattatccggcttttggattctccgttgtcctgggaactatccgggaccccctcttgcttctccagcccctgccggcatccacaggctggtagcgggacggggagggcgagaagagggagcgcaaggggttaattctgctgctgccgccgccgctgctgctgctgctgcagcctctacccgagggagggaaaggagaggagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61722 - DNA, 2810 bp, Homo sapiens
gagcggaggagacttcgccgctcggggcgcagctggtggtgaccgccaggaaccctcctccccttctcatctccccatctcagcagccctgcttcgattatccggcttttggattctccgttgtcctgggaactatccgggaccccctcttgcttctccagcccctgccggcatccacaggctggtagcgggacggggagggcgagaagagggagcgcaaggggttaattctgctgctgccgccgccgctgctgctgctgctgcagcctctacccgagggagggaaaggagaggagttgggcaaggcgagcatcatggcctcggattgcgagccagctctgaaccaggcagagggccgaaaccccaccctggagcgctacctgggagactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61723 - DNA, 1841 bp, Homo sapiens
aattccgggtcgaccccctcgtgcggaaatgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggacagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61724 - DNA, 2263 bp, Homo sapiens
aattccgggtcgaccccctcgtgcggaaatgcggcgtgagcagcggcccgaggctcccggagcatcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaatatatatcttttttttttttaatttgccctgtcatctttgggggctgtctcccatgtcgtgattttgacgtgatctctccgtgacatcaccgcgccatcgtgaagtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagctttccgagggttcttcgcatctggtacggcggcacggttcgttggccctccttttatcctctagagtcagctatgagga

SEQ ID NO: 61725 - DNA, 622 bp, Homo sapiens
cgagctcggtaccccgctattcatcggcaccctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61726 - DNA, 356 bp, Homo sapiens
tcaacctcgtggtcaccgcaccggggctgatcaagtgaggggctcgggagaggtgggggaggaggccggaggaggcaaaggaggctgcccagttgcctcaattctcagtctcctactttgccccccatgcccatggatttgttagtggtagcatgggggtctcagagtagacatagccagccccgcacaaggattcggcatgctggaacccccaggtactgtctcagcatgtctgcttgttccaatctctgccccccagatgctatgtttggggcccaaagttaatcaccctactgcctaatttcttgccaagggcttgatttggctgtactagacccccacctacctccatcctt

SEQ ID NO: 61727 - DNA, 439 bp, Homo sapiens
atctgcctctaaggagaaaaaaggagctggatgaaatgacctcagatgagtcctgttgcataacctcatcttgctagtcctcagtgccccaggatgcaggagagggacagtctttcccacttcttcctttcatcctgatgatagcacataccccctataggtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatg

SEQ ID NO: 61728 - DNA, 3787 bp, Homo sapiens
gggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaatactactgccttaggatttaatattattggccggtgttttacaacgttgtgattgtgcctttgtggttcctcaatttttgtcttgtatcacattccccttttgccgctggg

SEQ ID NO: 61729 - DNA, 3718 bp, Homo sapiens
aattccgggtcgaccccctcgtgcggaaatgcggcgtgagcagcggcccgaggctcccggagcatcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaatatatatcttttttttttttaatttgccctgtcatctttgggggctgtctcccatgtcgtgattttgacgtgatctctccgtgacatcaccgcgccatcgtgaagtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61730 - DNA, 3649 bp, Homo sapiens
gggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61731 - DNA, 3644 bp, Homo sapiens
gggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttcctccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61732 - DNA, 3781 bp, Homo sapiens
gggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatctgctatgactcctctctgcagagacgcgactggcggctccagcagggactacctttcttataaacccagggggaccacacacacacacacacacacacacacacacacacacacacacacacacactcttgatcccttactaacttactccaattcattctttcatcaccaacttcatcactacacacatatctacactcaataatattcattaccactaaataacacttaactcttactatacttttactcacatacccaattttcactataaatattctaattacaatataatttactcccattatacaacttcctaacttaatcaaaccttatccttaccctatcttattcaacctttcatcaccatacccctttccttcatcttacccttttactaaacattcccatacctaacaacttctcaaacattttccaaacctaatcctccattcccaattttaactctaacattttgtttaaac

SEQ ID NO: 61733 - DNA, 2511 bp, Homo sapiens
atatctaaggcaggcagctttgagcagagtgatctggtcaccaaagctgagccctgtaaagccaggcaaccgcgtggcaaactccacgatcttgatgatgcacttggtatccagctcactgaacttgtcccacagccccagatccaactgcacgcggtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61734 - DNA, 1651 bp, Homo sapiens
aattccgggtcgaccccctcgtgcggaaatgcggcgtgagcagcggcccgaggctcccggagcatcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaatatatatcttttttttttttaatttgccctgtcatctttgggggctgtctcccatgtcgtgattttgacgtgatctctccgtgacatcaccgcgccatcgtgaagtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 61735 - DNA, 359 bp, Homo sapiens
cctgctccatctcaagggggtcctgtggcaacaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggtgagtctgtagttacagtctgtccagctagatcattctaccgaaaagcgttaacacaaggacacccctccccacaaactgag

SEQ ID NO: 61736 - DNA, 3598 bp, Homo sapiens
atctctctgagacctctgcaaagatgtcccttttatgcccttgaccttgactcaccatgggctgctggggtgtcgggagaagccacacccaacatgcccattagcagaggctgctgctgatgtggcagctgctccctaccacccgccctggctccccagctgcaggttgcacaccctcagcctgagaatgtaaaatagggcagtgcccagctggggaggtagaggaaagtgctagagtacatggtccgtgtgtggcctagctcattccatgtcagcatttggtgttactcctgtccaaattctgtttgcagacttgtttcatgatgatgctctggaatgcttggggactttgggtggaggaggatgttacttcattttataaagaggaaggggcctgggagacttgggaaaatgtttctggagaggctttcagagtggctggaaaaggctcttgttgctgtaatttagagaggagctctgtgtccttggccagtcaagtaagttcctggatctttggcaaagccagaggaagaaaggagctacctgccctttcctgggcatgcttggtgactcagattgatcttggagtgtgcagtggcccttctaccctgcacctgacctcatgatcccctccacctgcactggtgtgcattactgaagcaagggtcctgtggacatcttgcattttgggcactgctagggggtctgggctgcttggaaggagccatggcctagggttcagggaactagactctatcccagttgggttcagactgctgtgactgtggacacgatgctccttgttctgggctccagttttcccatttgtgagatgaggcaacttccaatgcttctctaggccctgcacgtaagtgatttttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttgaacaggtgccttgggcatgatgtatagatgcagtcatatataccttgctggggtggggtgccacctccagtggccagctccagatccaaggagcagccccctggggatggaccccattcattcatcatgactcccaacagttttcattgtggaagaagaaactttggcattatagagacatcatcacaaaacagtaaaaacaaaatcaaccctgaaccccatgcactgtgctgcttcctgagcctggccctgcatcctcatagaggtgccgggttcctattggttagttggttgtttttccgtctgagtgaatttttgccagtcttgtgagcagatgtacctgatgtattctcaatgttccaagaggttctggccttcagggtcacaggcagtagggggacagcataaggtctatgtaaaacccttccctctctgaccctctgttttcaaatctgtaaaatgggcaataagactagatgatttgtatatagcccaatgcatctctggaactctgtctaaacaccagccatctacttggaatgggccccaggactgtggtatttgcctgggccaggaaaggataagaaatcctgtcatgtgaagacagcttgagaggcttgagaaaagtggggctggggagaagcaggcttgtcagactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtgctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctcttttttttttttttggagtagtacccttgccctcttcatggccacttcaaagtgaagccagcaaagtgataatactttatcatttagtattatcataaagtattaatactttgtcataaagtcctccttgagcccaggggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttt

SEQ ID NO: 61737 - DNA, 348 bp, Homo sapiens
gcggccgctccaacatcagaatggtaacaccaaaatgtcccagatccttgaagttgactcccaggggcatggctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttt

SEQ ID NO: 61738 - DNA, 3678 bp, Homo sapiens
atctctctgagacctctgcaaagatgtcccttttatgcccttgaccttgactcaccatgggctgctggggtgtcgggagaagccacacccaacatgcccattagcagaggctgctgctgatgtggcagctgctccctaccacccgccctggctccccagctgcaggttgcacaccctcagcctgagaatgtaaaatagggcagtgcccagctggggaggtagaggaaagtgctagagtacatggtccgtgtgtggcctagctcattccatgtcagcatttggtgttactcctgtccaaattctgtttgcagacttgtttcatgatgatgctctggaatgcttggggactttgggtggaggaggatgttacttcattttataaagaggaaggggcctgggagacttgggaaaatgtttctggagaggctttcagagtggctggaaaaggctcttgttgctgtaatttagagaggagctctgtgtccttggccagtcaagtaagttcctggatctttggcaaagccagaggaagaaaggagctacctgccctttcctgggcatgcttggtgactcagattgatcttggagtgtgcagtggcccttctaccctgcacctgacctcatgatcccctccacctgcactggtgtgcattactgaagcaagggtcctgtggacatcttgcattttgggcactgctagggggtctgggctgcttggaaggagccatggcctagggttcagggaactagactctatcccagttgggttcagactgctgtgactgtggacacgatgctccttgttctgggctccagttttcccatttgtgagatgaggcaacttccaatgcttctctaggccctgcacgtaagtgatttttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttgaacaggtgccttgggcatgatgtatagatgcagtcatatataccttgctggggtggggtgccacctccagtggccagctccagatccaaggagcagccccctggggatggaccccattcattcatcatgactcccaacagttttcattgtggaagaagaaactttggcattatagagacatcatcacaaaacagtaaaaacaaaatcaaccctgaaccccatgcactgtgctgcttcctgagcctggccctgcatcctcatagaggtgccgggttcctattggttagttggttgtttttccgtctgagtgaatttttgccagtcttgtgagcagatgtacctgatgtattctcaatgttccaagaggttctggccttcagggtcacaggcagtagggggacagcataaggtctatgtaaaacccttccctctctgaccctctgttttcaaatctgtaaaatgggcaataagactagatgatttgtatatagcccaatgcatctctggaactctgtctaaacaccagccatctacttggaatgggccccaggactgtggtatttgcctgggccaggaaaggataagaaatcctgtcatgtgaagacagcttgagaggcttgagaaaagtggggctggggagaagcaggcttgtcagactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtggctctgtggtagttcctagcactgcagacttcatgactccccacttaagtccaagtcacattgtctatcccagtgtgtagctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctcttttttttttttttggagtagtacccttgccctcttcatggccacttcaaagtgaagccagcaaagtgataatactttatcatttagtattatcataaagtattaatactttgtcataaagtcctccttgagcccaggggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttt

SEQ ID NO: 61739 - DNA, 2000 bp, Homo sapiens
ggccatagctgattcctgagggtaaaacgacggcagggaaagacccaagaatgacgagggctggttccggagcagaaaagaccgactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtggctctgtggtagttcctagcactgcagacttcatgactccccacttaagtccaagtcacattgtctatcccagtgtgtagctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctcttttttttttttttggagtagtacccttgccctcttcatggccacttcaaagtgaagccagcaaagtgataatactttatcatttagtattatcataaagtattaatactttgtcataaagtcctccttgagcccaggggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttt

SEQ ID NO: 61740 - DNA, 3103 bp, Homo sapiens
aaaggaaacacaagttgcttttgataacacatgatgcaaagaaagaattagaaagaatgagcaatgaagccggtataaatgacaaacaagtgtccaaaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtattatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgac

SEQ ID NO: 61741 - DNA, 5153 bp, Homo sapiens
cctggagtctcccctggtcgggagcctcagccttctggagactgacaccaccctcttactcagagacgaatcgttttgtcgttgccttcacctccctgaccacaagtgctccggggctctttctaagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtattatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgacaaaaaaaaaaaaaaacaaacctaaatgctactgttccaaagagcaacttgatggttttttttaatactgagtgcaaaaggtcacccaaattcctatgatgaaattttaaattaatgggcacctttcaacatcatttgcttccttatctacagttgattcagaaatctgcattttttattcttttatatgacttttaagtaaaagatttatatggatttga

SEQ ID NO: 61742 - DNA, 3450 bp, Homo sapiens
  misc_feature (3295)..(3295): n is a, c, g, or t
cctggagtctcccctggtcgggagcctcagccttctggagactgacaccaccctcttactcagagacgaatcgttttgtcgttgccttcacctccctgaccacaagtgctccggggctctttctaagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggtatgaactttttctgatcacccagaactgtggctttcttctgattgacaagtataaatgaacttttctttattagaagagaatatttcatctgattttgaaaaaaaaaaaaaaaaaagatgctcttcacctaacaagcttcaacctagtgaactaacttttcatgggttagctccacaagggactatattttcatctctactaatgacaatacttttgtgttatatttcttcctagaggtaagttggcatggtgtgaaggagccactgctgagggctccacttcactagcatggaatgtggacttggtccctaaacttaagtctagaaaataccaccctgtctattacatggagcagctgtgagaatagaataaagaaaattgtttccttttttcttttttctgagacaatcagtagtgcaatcaaggctcactgcagcctcagcctcctgggctcaagcagtcctcccatctcagcctccggagtagctgggactacagacacacactactgtgcctggctaatttttgtattttttgtagagacaaggtttgccatattccccaggctggtctctaactccagggctcaagtgactctcccacctcagcatcccaaagtgttgagattacaggcatgagccactgtgaccggccaagaaaattctttaccgataaaaaccttatttctatttacttggtcatccatttcaaccagacaagcttgaccaaagttgtggcctttttctggaacattgcaaaaagtttctgaatgcttttgacttcaggagacaaacgaaaaccctccaataaaacaaagaaaactgttttgtcatctctttctccttatccatgaaaggtgaatgtcagctttataactgaaatgcccctcctgtttaattcactcatgaggtgccacacttttgtttaacttcggccatgggaataattattaatcacattgaatcagagaggtgggtccaccataattagatgtaagcagtaatcatggattagaattagttactatattcttctgcattcaatgtatgttctcttatcattaaatgtcctaaaataagaaactggtctcattcaggagcaaatacttcgtgcaaactaaacgccaagattctgtagagatgcagggccctgtgtcacgtttatagaagacataggccccatgaacttggagttctctgttgtctactttctccgctgaataaatacaacaggaaagtaattctttttagaataaataaaaagttatgtcctccctcccttaatagttttacgtgatgctaacaataggcttttcagtttgaaaacaggcaccagcctacattacagaatgaactttgaacaaggttcactttgaaagtttaatcagtgacctaggtgtagcaggagttaccnactcttatataaaaattataaaatcttttgtttgcatataaaagtagtcatttctaattcagatttttaacttgaatgatagttatagggagtacttgatccactttttcatttttttcatctcgtttttcatttttgtaatctacgacacaaac

SEQ ID NO: 61743 - DNA, 4769 bp, Homo sapiens
cctggagtctcccctggtcgggagcctcagccttctggagactgacaccaccctcttactcagagacgaatcgttttgtcgttgccttcacctccctgaccacaagtgctccggggctctttctaagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtattatacttgatgttggtcatttctcagtcctatttctcagttctattattttagaacctagtcagttctttaagatgtgaaccagattttccaaatgcctaaaccacttctgagctttaagcaaggcctcagaaattcagcgggtgcctgggaggcttcattcacattc

SEQ ID NO: 61744 - DNA, 4612 bp, Homo sapiens
cctggagtctcccctggtcgggagcctcagccttctggagactgacaccaccctcttactcagagacgaatcgttttgtcgttgccttcacctccctgaccacaagtgctccggggctctttctaagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggcccgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagatctgtctagggtctaaaataatagaactgagaaataggactgagaaatgaccaacatcaa

SEQ ID NO: 61745 - DNA, 2559 bp, Homo sapiens
cctggagtctcccctggtcgggagcctcagccttctggagactgacaccaccctcttactcagagacgaatcgttttgtcgttgccttcacctccctgaccacaagtgctccggggctctttctaagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaaaagacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttataggatagctttattagatgtcattctgggttttttatatatagtt

SEQ ID NO: 61746 - DNA, 1718 bp, Homo sapiens
cctggagtctcccctggtcgggagcctcagccttctggagactgacaccaccctcttactcagagacgaatcgttttgtcgttgccttcacctccctgaccacaagtgctccggggctctttctaagggaggcagctgttctaggcgggaggctggagtctcctgggcctggacgcaccccggggtgtgagtgatgggtatgcctgaaaggaggggaagtggcgcggctttaatcatctgggctagtccccggcgggcctgggggaacagggaaactggaggcggccttaaagcgtcaggatgagacatcgcaagaggagctgcagatactgagcgtgcgccccgggttctcgccgccttctctccgccgagcagcccttcggccaccctttgcccttaaaaatctgcagactgcgcctcctctccgcgggagcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaagtaagcaactttttctcttttgtctttctctttttaatatgaatgcatgaaaggataaaatggaggcatttgcttatga

SEQ ID NO: 61747 - DNA, 452 bp, Homo sapiens
tatatggcacaatagaagtattcctttcacttacctgagctgaagtttgctgcatctgattaacagagaatggcctcagttgtttcagaatctttgtattgtgggatataaatatacctcattacacacacacctctgtttttgtctctagtatgatgctgtccgaataaaccaactctatgagcaagccaggtgggccattctcttagaagaaattgattgcacagaggaagaaatgttgatctttgcagctctacaggtatgggaacttcagtaccttttctctggaaggagacaaaccaagtttgttctgcttgaagtttcatatgcttcatactggtttttttttgttctttgaagaaatatctgaaaataaggagagcaattgttttctgtattttttattttgctttcttcttcagaccagaacaaatttttaatttaaaatgctc

SEQ ID NO: 61748 - DNA, 1014 bp, Homo sapiens
tcctgggtttgtttttcaaaatatttatataataataatacatgtaatatttatagaaaatacatggacagatataccaaattttagacaataattaattttagagagatgagattacaagaggttttctttttctattttatataattcttaatgtttctcacttttacaacaaatatttctgtgaagtaaaaaaagtactattatacttgttatatatttgttataataaattaaagaattaaggaatttggttaaatctaaaaacaggagctttgttttatgggtgacataggtcacagtggaaaaaagttatattattaatatagtagtttttttttgagtttgatgacattcttttgataatcttgagttggtttttttaacgtaagactagcctcactcactgtgagctggtaagattccacagaggagtcatctattttttttttcctcagtagcataataataattttagctagcttgccatctggggacccttcctaagtggtagataagaaacttaaaataggattgtactttaccatcatatttccccacccagcactgttactggcataaatatgtgagcaagtgactggtgagagagtgatgcctttggcagggtatctgatggtgagatcgactgagaactgagtggaagagaaggcgaagtatcagattgccaaaagggcttttattcttagctcagcccttcacgtatcctgcaaagagctgctcagcaaaaggtgcttattgaattacacctcataacaggcagaatttgaatgctgttcatcacaggagctatggagtgcatagttttatagagagtatctccccgcaggcaagatacatagaacaggtgcagaattacagcatatactcatttcgcctcttgttaaataaaagcaaagacagtctcatgcgatcctgtgtgctgagtagaatatccattatagagcattttcttttatttttgttaatatttttacttgtagatttcccattaaa

SEQ ID NO: 61749 - DNA, 366 bp, Homo sapiens
tcaggtgatctgcccgccttggcctcccaaagtgctggtattatacaggcgtgagccactgcgcccggctaggaagctcccctttctatcctgtgttcagcccaaacctgctctcagttttctcacatatgagaggaaatacaaatttgtgccaaaatgtaaataacattccccttgagacattgacattttgatagagaacaattcttgcgtctctcaggactgaatctgtgtagtgtaattctggcctccctcctccccagcacataggtgctctttattcagctcaattccacaggtccatcctgaggcctctggcagactggagggaagttggatagctcttggtctactcagtcctacaca

SEQ ID NO: 61750 - DNA, 303 bp, Homo sapiens
gaatgctataattttcttaattctcagagagctaatgcagcaatccaagatttatgccattctaacctctttagactcatattcgcagcatttatatgtatgtttgtgtatacatataaatctatatgaactattccaatttttataggataccatggattcttttttgaataaatataaggatatataaaaaatatattcaagtaactataactaaatattcatcagacattaagctgataaactaatatttcagactacgtaattactttggagacattttttcatgaaaacaataatttt

SEQ ID NO: 61751 - DNA, 158 bp, Homo sapiens
tctgtgtggaggggagggacccagtctgggcccaggtgtcatcatctcagccacagcagggccctctcaggctgggaaacttctgccagagctggtgagtcctctgcaggtcaagccagggcttggacacagctacttcatttcctgtgcaggaagag

SEQ ID NO: 61752 - DNA, 102 bp, Homo sapiens
  misc_feature (30)..(30): n is a, c, g, or t
aatttaagcatattagtcagcggaggagangtgaggctggcttggggcttcgtctcggctctgggctccttccccacacggctgaccctgaaggagcagccc

SEQ ID NO: 61753 - DNA, 273 bp, Homo sapiens
aaggaaggaaagtcaaaaggacatgagccaaactgaaagagctgttaagtggccaaaactagaacaatttgaaaaataaaatgatagtattagattataacctaaaaagcaaaataaattgaggagatactttaagactgtgcagatatcctttttctccttaattatagaggggaaatactaactttacaagggaagaagctggcagatgccaccttaacaaagttgtccaggctaacaccacaaataataggacatattgatatttcaaac

SEQ ID NO: 61754 - DNA, 398 bp, Homo sapiens
agagttttaaatgcttgtcagcagccactaactcagcagatgatctccatgaagactgaatgaaaacactacaagaacaagaatcatcaaaagagcctatcaagattctagtttgtaaccaacagatgtctacagaaagaaaacatgtaaatactgaggctgagccttgaggataaggtgttaaaaactattggaaatgcaaggacacaagcagcagagtaaaaaagcaacctacagaatgggaaagaacatttgcaaatcatatatgtgatagggagttagtatctagaatatataaaattctgcaactcaacaaaaacaaagttctggagattggttgtgcaatattgtgaatacagtttacactactggactgtaaaatggttaagatattaaac

SEQ ID NO: 61755 - DNA, 665 bp, Homo sapiens
gcttcctttgttaataatatgtgactccaaactgagattcagcaattgttaattttggcctgggtaacaaagtagcttcttgttttaactatggagagataatgttgtcggtaaaacagatcagtcttaccaaaatatattcttcaaatcttctgttgcaagaaatgggggaatatggttaatgagagttctagtcagatttggagagaggaacagagggtgtaaagcacatttatggacacatgggtggcatgggcattcgggaaggatgctgccggagggtaggtcgagtgtgatgcagggaagcctgaaggtcgtgtttggatcagccagggtcagcatgacctgtatagcaaagggactttatgaataccatgtattgaccaggcacagtggctcatgggtgtaatctcagcactttgggaggccggggcaggtggatcacttgaggtcaggagttcaagacccagcctggccaacgtggtgaaacccgcatctctacttaaaatacaaaaactagcggagtgtggtggtacatgcctgtagttccagatacttgggaggccaaagctggagaattgcttgaacccaggaggcagaggttgcagtgagccaagatcaccccactgcattccagcctgagtgagactccctctcaaaaaaaa

SEQ ID NO: 61756 - DNA, 429 bp, Homo sapiens
aaaattagccgagcgtggtggcaggcgcctgtaatcccagatactcaggaggctgaggcaggagaatcgcttgaaattggaagatggaggttgcagtgagccaagatcacggccactgcactccagcctgggcaaaagaccaaaactccatctcaacaacaacaacaaaaaagagccgggtgcagtggctcacgcctgtaatcccagcactttgggaggccaaggcgggcagatcatgaggtcaggagatcgagaccatcctggctaacacggtgaaaccccgtctctactaaaaatacaaaaaaattagccgggtgtggcggcgggctcctgtagtcccagctgctggggaggctgaggcaggagaatggcgtgaacccgggaggcagagcttgcagcgagccgagatcgcaccactgcactccagcc

SEQ ID NO: 61757 - DNA, 2642 bp, Homo sapiens
cgaaatatatcggctaggtagcgaggctgggtggtgacgctccaagatggctgcctccatagtgcggcgcgggatgctcctggcgcggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61758 - DNA, 821 bp, Homo sapiens
tccgaggatagggtcacgtgagatacttttctggggaagatttgttctgaaacaaaaatagtatctcagtgacttgttttaagagtatccttacctagagccatatatgtcagcctctcaaatgccctcagcccagtggtttatattatacttcctcagcccaaatgagaaagaagaaaactaagttcatgtaatttggcattacaaaatggatacagtgaattttaccacattcgtcattatctatctgaagtgtcaccgaatgagatgagtctgtgggtacagatttaaaatgatccttctctatttctagtgctgccaggtgaacattcacttgggccttcaggtcctcagtcttagaaatggtgggaagacatggctgagcattctttattgttctttttggccacagggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcggtatgttcttcagctctaaggcagtgagatttagccatctgtttcccataacctgagctttaaatttgttttcattgtctttccactacccctactttctatatgtctatagaataggtatttatcaagtcgaaaaaatgcaaaaccacaaacattttcaatgctcctgaccaaaggcactagaaaatatgattaacattgatttatagttcattgtctaggaaaaaaaaactattccactgcctcgtccctcacctccttaccaa

SEQ ID NO: 61759 - DNA, 2672 bp, Homo sapiens
ctctgtccgtaacccgttggctgttccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61760 - DNA, 2823 bp, Homo sapiens
cgaaatatatcggctaggtagcgaggctgggtggtgacgctccaagatggctgcctccatagtgcggcgcgggatgctcctggcgcggcaagtggttcttcctcagctctctcctgcaggttggccggacagcttcattaggcccctgattattctgttttttgggtgaagggagcggtgggctttcaagaggagaggaaacgtttctggaatctgattgctagggacgccatttggggtgtttggtagtgcagaagaaggagacaaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61761 - DNA, 2564 bp, Homo sapiens
cgaaatatatcggctaggtagcgaggctgggtggtgacgctccaagatggctgcctccatagtgcggcgcgggatgctcctggcgcgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61762 - DNA, 2596 bp, Homo sapiens
cgaaatatatcggctaggtagcgaggctgggtggtgacgctccaagatggctgcctccatagtgcggcgcgggatgctcctggcgcggcaagtggttcttcctcagctctctcctgcagctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61763 - DNA, 2938 bp, Homo sapiens
agcaagggacactgcggcgtgtgggtgtgggcttcatgtgccagagcgccgtctcccctgagccgtgccctgccggggagtacggcgagagagaggttctggcctctcggagtgggcttgcggttccggtgccccctctcttcgtcctcgtggctgattgtgccagagagctcctcggggagggccctagcgtgagggcagtttcccagcgccggggccgcggtggacgccaatgcagctgtctaggacctgcgcccgcggtgcgtccagagggccccggcgcgaacgtcagaacgccgccccgttccgcgctctcagcagccagccagggccgctgccagttccaccgtggagaggaggaaaccgggcgagagcctcactttcctttccgcccaaaaagctttctcagtgattgctgtagtacctgagattctaccataggatcttccgcctacattaaactgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61764 - DNA, 3277 bp, Homo sapiens
  misc_feature (2691)..(2691): n is a, c, g, or t
  misc_feature (2693)..(2693): n is a, c, g, or t
ctctgtccgtaacccgttggctgttccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatgaaaaaaaaaaaaaaaaaananaaaaaaaaagaagaaaacaaaaaaaaaaagaaaaaaaagaaaaaacaaaaaaaaagaaagaagaggggggggccccgacgagaagagaatactccaccaagaggggagcgccgaaacaaaataacgagcggagcacacacggagagttctgtgaaaaaaagagaggggggccgaccaaataagagagaggaggcgaagaaaatctaaagaggaaaggaagaggcggcgagagcagatagaaagaaaaaggggaagtaaaggaggaaaaaaaagcgcggtacacaggcgagggcaaaaattactgggggaaaaaaaagaaccaaccaacccaagaaggggggggggcggaaaacacaaaaaacaggagagaacaaaacgacatcacacacaaaacaaaaaagaattaggaaaaccaaccacgaaggaaggacaaccaaaacaaacaaaccataaccacaagagacatacgaaaacagggggtacgtaaacagccaaactgaggagcaaaaacagcggaagccaggccgagaaaaaaaaaagataggtgaaaaaacaaggagaaagaaacacgactgcgagaaaac

SEQ ID NO: 61765 - DNA, 2795 bp, Homo sapiens
ctctgtccgtaacccgttggctgttccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatgttagtgtactctttatctttggggaaagggaggagggagagggactcattattgttactatgattttgaggagtgtactttaaaccctcccccattaaactatgggatttattgtaataatga

SEQ ID NO: 61766 - DNA, 2643 bp, Homo sapiens
ctctgtccgtaacccgttggctgttccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61767 - DNA, 2149 bp, Homo sapiens
ggaagaggagaggaactttggtgcatcccaactgaagtctgtcttctttgccaggcaatgaaataaaacatagagggagagaagttgggtggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61768 - DNA, 2449 bp, Homo sapiens
ctctgtccgtaacccgttggctgttccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61769 - DNA, 1820 bp, Homo sapiens
tccccacgttgacacttcagagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61770 - DNA, 2346 bp, Homo sapiens
tccgaggatagggtcacgtgagatacttttctggggaagatttgttctgaaacaaaaatagtatctcagtgacttgttttaagagtatccttacctagagccatatatgtcagcctctcaaatgccctcagcccagtggtttatattatacttcctcagcccaaatgagaaagaagaaaactaagttcatgtaatttggcattacaaaatggatacagtgaattttaccacattcgtcattatctatctgaagtgtcaccgaatgagatgagtctgtgggtacagatttaaaatgatccttctctatttctagtgctgccaggtgaacattcacttgggccttcaggtcctcagtcttagaaatggtgggaagacatggctgagcattctttattgttctttttggccacagggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61771 - DNA, 1878 bp, Homo sapiens
acttcgagctcggcaccccacaccacctgagtccaagtggagaaagtggctgcctccccagaagacataaagctgtgtagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61772 - DNA, 1206 bp, Homo sapiens
ctacacaacatactgtctaggtacgaggctgggtggtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61773 - DNA, 1597 bp, Homo sapiens
tccccacgttgacacttcagagagaagcgctcgatgtgctgggtgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcatgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatg

SEQ ID NO: 61774 - DNA, 543 bp, Homo sapiens
cgaaatatatcggctaggtagcgaggctgggtggtgacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtaagttttccatttgatttggctatgtactctgtgatttcacaccccttttttacataaaagttggtatatgttgtgtataattttgacaccttctaagtttatattttaaagatcttttcatatgagtatagagagagtttctgattttttataactgcattttattccatactgtgagtttattatttaaaccagttccctttttatggacct

SEQ ID NO: 61775 - DNA, 563 bp, Homo sapiens
cgaaatatatcggctaggtagcgaggctgggtggtgacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtggaattttacccgatgtgaactgttatgtacctattttcagttaacactgttttaaaaccttttctacattaccacatttacttcactctttctcacagctgctaacaattccattgtgaactacccacaaaactcagccatgtgtacaaaaagtatgttcagtgcaacatcatttatggtagcaaaagactgaaacaacctaatgcacattaaataaagaactggtcaaacaa

SEQ ID NO: 61776 - DNA, 2891 bp, Homo sapiens
  misc_feature (1229)..(1229): n is a, c, g, or t
ccagctggcagtcaaggctgtaggagggcatggagagttgaagaaaaaagcagtatcttgaggcagactggaagagtcatcacagcatccaaatcaacaagaaaacatcattccagggtcctacatgatggcgtactctgatactacaatgatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagngggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgcctacagacatcatcggaggcccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataataaatgtgtgtcattg

SEQ ID NO: 61777 - DNA, 2907 bp, Homo sapiens
  misc_feature (1245)..(1245): n is a, c, g, or t
agcggagtctggtccaacagctgacaggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaaggtcttcttctttttttagaacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagngggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgcctacagacatcatcggaggcccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataataaatgtgtgtcattg

SEQ ID NO: 61778 - DNA, 2919 bp, Homo sapiens
  misc_feature (1257)..(1257): n is a, c, g, or t
cggaattcgggggaagatgtggctgctggcacttggagccaagggttcagagactcaggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagngggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgcctacagacatcatcggaggcccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataataaatgtgtgtcattg

SEQ ID NO: 61779 - DNA, 2888 bp, Homo sapiens
  misc_feature (1226)..(1226): n is a, c, g, or t
agcggagtctggtccaacagctgacaggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccagaagtatgccttgggtttccaacatgcactgagcccctcaacctctacctgtaaacataaagtaggagacacagagggcgaatatcacagagcatcctctgagaactgctacagtgtctatgccgatcaagtgaacatagattatttgatgaacagacctcaaaacctacgtctagaaatgacagcagctaaaaacaccaacaataatcaaagtccttcagctcctccagccaaacctcctagcactcagagagcagtcatttcccctgatggagaatgttctatagatgacctttccttctacgtcaaccgactatcttctctggtaatccagatggcccataaggaaatcaaggagaagttggaaggtaaaagcaaatgccttcatcattcaatctgtccatcccctgggaacaaagagagaatcagtccccgaactcctgcgagcaagattgcttctgaaatggcctatgaagctgtggaactgacagctgcagaaatgcgtggcactggagaggagtccagggaaggtggccagaaaagctttctatatagcgaattatccaacaagagcaaaagtggagacaaacagatgtcccagagagagagcaaagaatttgcagattccatcagcaaggggctcatggtttatgcaaatcaggtggcatctgacatgatggtctctctcatgaagaccttgaaagtgcacagctctgggaagccaattccagcatctgtggtcctgaagngggtgttgctaaggcacaccaaggagattgtgtccgatttgattgattcttgcatgaagaacctgcataatattactggggtcctgatgactgactcagactttgtctcagctgtcaagagaaatctgttcaaccagtggaaacaaaatgcctacagacatcatcggaggcccatgctgaagcgcttggtcagtgcccttataggtgaggagaaggagactaagtctcagagtctgtcatatgcatctttaaaagctgggtcccatgatcccaaatgcaggaatcagagtcttgaattctccaccatgaaagctgaaatgaaagagagggacaaaggcaaaatgaaatcagacccatgcaagtcactgactagtgctgagaaagtcggtgaacacattctcaaagagggcctaaccatctggaaccaaaagcaaggaaactcatgcaaggtggctaccaaagcatgcagcaataaagatgagaaaggagaaaagatcaatgcttccacagattcactggccaaggacctgattgtctctgcccttaagctgatccagtaccatctgacccagcagactaagggcaaagatacatgtgaagaagactgtcctggttccaccatgggctatatggctcagagtactcaatatgaaaagtgtggaggtggccaaagtgccaaagcactttcagtgaaacaactagaatctcacagagcccctggaccatccacctgtcaaaaggagaaccaacacctggactcccagaaaatggatatgtcaaacatcgttctaatgctgattcagaaactgcttaatgagaaccccttcaaatgtgaggatccatgcgaaggtgagaacaagtgttctgagcccagggcaagcaaagcagcttccatgtccaacagatctgacaaagcggaagaacaatgccaggagcatcaagaacttgactgtaccagtgggatgaagcaagcgaacgggcaatttatagataaactagtagaatctgtgatgaagctctgccttatcatggctaagtatagcaacgatggggcagcccttgctgagttggaagaacaagcagcctcggcaaataagcccaatttcaggggcaccagatgcattcacagtggtgcaatgccacagaactatcaagactctcttggacatgaagtaattgtcaataatcagtgctctacaaatagcttgcagaagcagctccaggctgtcctgcagtggattgcagcctcccagtttaacgtgcccatgctctacttcatgggagataaggatggacaactggaaaagcttcctcaggtttcagctaaagcagcagagaaggggtacagtgtaggaggtcttcttcaagaggtcatgaagtttgccaaggaacggcaaccagatgaagctgtgggaaaggtggccaggaaacagttgctggactggctgctcgctaacctgtgagctgatccttgactcctcttcatcttagcccccctagcagcattccatcccagccagagcacccccaccatcaggccagtcaactgcacaatacacaactgtatttcccaatacacttgagcagttgcctgtgaatgtaagaggtgtcaacaaactgggaaataaaataaaaaaaaataataataaatgtgtgtcattg

SEQ ID NO: 61780 - DNA, 415 bp, Homo sapiens
aggggcagaaaaggggaggctcctcagatggagagttggggagagaaggagggatttggagccagggcagacagagcagcatggtgctgggagaacaagaggggcagccagtgataaggagagcacagggagaaccacagcctggggagaactgggatctggggatgccagagaggggacaggtggatatagcagggaagaggggatttaacaggggaagctagggggcagcagagacggggggaagaaagaggcagaactatatgaaaattggagacaaatattgggcagaaagaagaataagaggtgaaagaagtgagaaaggagcagaacaagtggaagagaaggaatagagggaagagcaggagaaggaagaagggcttgaaatgaggagaatcctaggggaaaaataaag

SEQ ID NO: 61781 - DNA, 366 bp, Homo sapiens
actcttaaattaacttcaaatcagattaatctgagatattcaaattaaaatgatgatgaaggtgggggtggtggtggtgatgatgatgatgatttgtcaaagggattcttcatttatagacaaggcagaagacattatcagtggtatgcatatactattccccaacttagtcaagttacccaccaaattccgtatgtgataagcatatttcccttttaccgcatcatcaagcaaataaaaacacacttttctcatgtactccaagaatcatgctatcatcataaaattagctatagaaactgcattctctaaattttaagagagaaaatgtgtcccttgaccaagatctctattcctcactggtgc

SEQ ID NO: 61782 - DNA, 184 bp, Homo sapiens
cttatgaactcttaggatgttcaccctttggatcctggagacaaaatgattctgcattgaacatttaaagacacctcttgcttctttaaatcattttagacttcatagaggtatcaggaaattttcagaattgtggtgccatgttgacaactgttctgttggcagactggcagctgaaataggg

SEQ ID NO: 61783 - DNA, 503 bp, Homo sapiens
agtgctgacttgggtcccattctcaggctgtttctgagactcttcaagccgtgtttacaggttcttttttattctggggcccttggtacagagttgagtcaaaagtgctcagttgccagcacagagcctctgtggtctgtaaatcctcagcagtgtcaatcctataaatcccgggctgggctgcactccaccttccctacttcacccttgccaccttgtcacctgcttctccaggctgttgtgctcttccatgctgattcacaccctgcttcctgtttacccttccccagcacagaaaaggcagacggcactggacagcccacaactctagagtcagcagcatctctgtctggccgtggggtgctggtaaacatttagccacctgctggaggggctgagccctagcgtttgcaattcctgtgatttcaagctcccggctgtgatgttattgaatggagttgggaagagatgcacaatagcacatgtttatattgtattttcct

SEQ ID NO: 61784 - DNA, 434 bp, Homo sapiens
aacaccttgagataactctacaaaaccaggatcaaattatcacaaaaaaacttcacagagtgaagaatgaaggaaaagaaaaatgatcacaaatgggtttttgttttaatcaggaaatacggttatacacatctacaagcaaggactggatgttctatgtcatggatctcccaaaacccctggcaccattggttgacggtccaaagtatttgacttgctaaagaatctttccctcctagaagtataaaattctactttattttccctataaaaacaaacaaaataactatatatatatgctgatattgaaccagaattacaaataatttgtaatgtcagatatttaaattctacctattttataatatttatttcacaaaagtcacaagactcactatgttatacaatagagttttcagaatcactttacagaa

SEQ ID NO: 61785 - DNA, 185 bp, Homo sapiens
gaaccctggatcttctccataatccagttgtcctcaccatcccgttaccctgccgtcccttctaattcaatccaacctgcaccaacacccagaatttggtgtaagtggaaacccaggggcagcacagggctgggcgggaagggcttaaggtgtcctctacccaggaggggacttgctcttgcttt

SEQ ID NO: 61786 - DNA, 274 bp, Homo sapiens
ggtaccatggctagtgtcatagaatgctgagagcacagctcctgctgatccccacacagccaatcacaccctcctgcgggaatgagggcaccccaactttttgataccccaaaacctgtctctcacagcccctggttgttcacactcttcccaagtgcagccctgggtggccctgtgtaacatgtggtgtcctcctcccccagtctgttagtctatgtgacaaatacacagctgccattctcatctgtcctgtggcaggtgttgtgttctcagc

SEQ ID NO: 61787 - DNA, 1719 bp, Homo sapiens
ggcatatgaagtgtttgagtggtgaatgttgcaccacaagaatagatgtgccttgcttttgttctgactggtattagcaaaaagagataactatcggaatgtggtagcgccaaatttgtgattttgagtgtggcacttagaagtgaatacatcagctactagtaaacgctaggtcattgttgtacacgatatacttaagtcagattttaatattaaaagtgactttagttgagatacactgttgcatcttgaccaaatggtagattcttgctataatgtgttctcttcccattagctgctggtttaattttaatcagagggtaaaaatgtcacagtatcttttccccagagatgaattgtcagaaattgttgggaactctactgttgaagcatttcctaattacttgtttgtttggcacattaactatttacaccccatgttttattcctttcctgctgctgtgtcaaaataccttagaatgggtaatttataaacaacagaaatttatttctcacagtttgggaggttgggaagttcaagatcaaggaaccagcagatttggtgtctggcgagggcttgttcatcataaatgatgccttttagcggtattctcacatggagctgaacgctgtgtcctcatgtggcagacgacatggaagggcaaaaagtagctagttctctcaaccccttttgcaaggcctaatccctaattacctcctaaaggtcccacttcttaataccatcacctgggggtttaagttccaacatacgaattttggagggacacatacattcaaactgtggcaccccaactcagaaagtttccatgttcacagcagtgaacaaaaatgaacagaaatccttgtctttatactgtttgcattttaatacttactgtcagttaatgttatatactgttatttatattgatgtatactgatgttgtgtgtgtgaaatggctttttctggttagtatttgagtttaaagtaagattcatatgttttccaacttttaaatttttcatctataaaagtataaaaagaactaatggaagactttgctaagcaaatccaaccttggtattcacaatagaaaaataagggctttgaaataacaatgatgacaatttctgaagcccataattccattccatcacactattaaaaaaaaaaaaaaaaggaacatcgataggaagtctgggttctagtccaggttctgccattaagtcaactgagtttacttctcatctctggacctcagtatccccatttgtacaataaagagggttggattagatcagtgattttcagattgttctcttcagaggccttggcttttgtaaagatcttagggactgcaggaggagaactgtgcagatgcagaggtagacctagtaagcttccttccccagcttcaaaaaaaaaactatattatacttatcagttttatatattgggcttctggagagatatttggctttcttttatttaaaaataatttgagattgaaaatgttgatacagatcagaccttggttcccttgtaaaatgctaggattttattgaaaatggataaattactgctttcttggatcttacagtaataaccctatagattccttatatgtgactattttctaggaccaaggcaagaacttttattaactcttctgcctgtaaaacttggtagcttttaagattatcttgcaatgaacacaa

SEQ ID NO: 61788 - DNA, 337 bp, Homo sapiens
gtcttttcttctgagtatgctagatattgtctattgatacttaataccatctcaaatcctttaaactctaatttgtatcctaatggctagaaacctgaaacctgtattttacatattcttttgacatttctggcctacgttttcactagtaagaagcagttgaatgatatttggaagattaaagagaaagggaagccattattctctgttggtagcagcagtggctcctggacccatcgacccataggcagataatggatttgaggtgtgcagtgatttcttagtaagttcctttgttctttgatactacggatagttaaaacacttagattttttt

SEQ ID NO: 61789 - DNA, 356 bp, Homo sapiens
ctccctgctccccccaccccacagcagtccccagatgtgatgttccccttcaaaatcttaaacattaagctatgaatctattttgaattctaaatataaaatttcacttaaaacatacattttacgtaaactaatcatgcaaatcattttaataattgtcaataaatgcctttctccttaaataactcaaattcaattggaaagtaggtatcatttaataaatagaaaacatcaagttctatctctctgtaaggataaatcttatattaagataacattttatcatggagattagtaatacatgagtctaaagtaaatattataaaataaaaatagcttattcatcatgcacacat

SEQ ID NO: 61790 - DNA, 534 bp, Homo sapiens
tgagcagaatctacacagtccctacctgtatggaacttacatcctagtggaggaaaatagataaatacagggaagtaaatctatgatgtaatgtgggtgctaaataagaaaaacaaagctggataagggaatagagagtagaagggactgctactactttagatagattggtcaggaagggcctttttgaggaggtgacattgaagcagagacctgtcattatactgaaactagagctgaagtggacctcgtgttcccatccccgttttgcagatgaggaagttggagcagcaaggataaaggtatggcccaagatttcacagctcgacaggaatctcttcctgatataaaattctgaaggtattttcactagagcaactggtagctcttggagagcaaactggggttggccaggctgtgttcctaagcaaggaagcttttgaggtatccttcaaaggctatcagaatctgccttttcagttcatcctattttagcaagaataccttaagaatttcaaatgggaaaaaaagcaa

SEQ ID NO: 61791 - DNA, 169 bp, Homo sapiens
ctctgccgttatttatggatgcgcctggcctctcggtggacagagaaaatcaccaggccccgggggccttgtcttactcatccctgtgtggagctcccagcacaggccttggcacagaaggccagagtgaaggaagcatcagttgagcctgaggcacctggaaggccag

SEQ ID NO: 61792 - DNA, 415 bp, Homo sapiens
ccttttcattggtgtataatattatatataggcacttgatggatagcagtttgaggtgcttaccagtaatagtcaaacataatgcacatgtactttaggacacatgtattcacacaaaattggaattgccagatcctagagtagtcatatgttcaacttaggagataatgtgtgttataaatttcatctactcagtggcttctttcagtctctaaatgatctcattttaactttttaaaatgttatttatttatttttgagatggggtgtctcactctgtcaccgaggctggactgcagtagtgtgatcatagcttattgcagtctcaaattcctgggatcaagcaatcctctcacctcagcctcaggtagctgagactacaggtacgtgccaccatacctgactaacttaaaaa

SEQ ID NO: 61793 - DNA, 465 bp, Homo sapiens
gggccgggtcgggtggtgggcagccgccggcgaccgccacgcaaactcgtgccgctcgcctacaagcagttcagccccaatgtgcccgagaagaccctgggcgccagcggacgctatgaaggcaagatcgctcgcagctccgagcgcttcaaggagctcacccccaattacaatccacactcctcaagacacatccagagactgttgctgtctgtgggcagagttctgtgttctggccaatgtgaccgtagtgccggggactgggggaggtgggttggatgtgcttgccacccccccggctaagctcccccttctgctgaaccatgatccccaccccctccgccggtcagtctcccataccttatttattggagtggagggggaagcccatgggagaattttggggatgttttggtcttttcttccttttgtaataaaaattatttaagttgtagaaaaaaagag

SEQ ID NO: 61794 - DNA, 1746 bp, Homo sapiens
ggagaacacaggcgccgaccgcctcatgacccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcggtggacatcaccacatcagaccgcgaccgcaataagtatggactgctggcgcgcttggcagtggaggccggctttgactgggtgtattacgagtcaaaggcccacgtgcattgctccgtcaagtccgagcactcggccgcagccaagacgggcggctgcttccctgccggagcccaggtacgcctggagagtggggcgcgtgtggccttgtcagccgtgaggccgggagaccgtgtgctggccatgggggaggatgggagccccaccttcagcgatgtgctcattttcctggaccgcgagccccacaggctgagagccttccaggtcatcgagactcaggaccccccacgccgcctggcactcacacccgctcacctgctctttacggctgacaatcacacggagccggcagcccgcttccgggccacatttgccagccacgtgcagcctggccagtacgtgctggtggctggggtgccaggcctgcagcctgcccgcgtggcagctgtctctacacacgtggccctcggggcctacgccccgctcacaaagcatgggacactggtggtggaggatgtggtggcatcctgcttcgcggccgtggctgaccaccacctggctcagttggccttctggcccctgagactctttcacagcttggcatggggcagctggaccccgggggagggtgtgcattggtacccccagctgctctaccgcctggggcgtctcctgctagaagagggcagcttccacccactgggcatgtccggggcagggagctgaaaggactccaccgctgccctcctggaactgctgtactgggtccagaagcctctcagccaggagggagctggccctggaagggacctgagctgggggacactggctcctgccatctcctctgccatgaagatacaccattgagacttgactgggcaacaccagcgtcccccacccgcgtcgtggtgtagtcatagagctgcaagctgagctggcgaggggatggttgttgacccctctctcctagagaccttgaggctggcacggcgactcccaactcagcctgctctcactacgagttttcatactctgcctcccccattggggagggcccattccatccatcttaggcccctttgggtgggcttgcgcctcagttgatgctgctaaattccctgggagccagcatggatctggctggacccgatgctgtccagaactgggaaggccacaggggtggggcagccatcccggccattctgaggtatgacattcctccccggccacactcctcaagacacatccagagactgttgctgtctgtgggcagagttctgtgttctggccaatgtgaccgtagtgccggggactgggggaggtgggttggatgtgcttgccacccccccggctaagctcccccttctgctgaaccatgatccccaccccctccgccggtcagtctcccataccttatttattggagtggagggggaagcccatgggagaattttggggatgttttggtcttttcttccttttgtaataaaaattatttaagttgtagaaaaaaagag

SEQ ID NO: 61795 - DNA, 1375 bp, Homo sapiens
ggagaacacaggcgccgaccgcctcatgacccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcggtggacatcaccacatcagaccgcgaccgcaataagtatggactgctggcgcgcttggcagtggaggccggctttgactgggtgtattacgagtcaaaggcccacgtgcattgctccgtcaagtccgagcactcggccgcagccaagacgggcggctgcttccctgccggagcccaggtacgcctggagagtggggcgcgtgtggccttgtcagccgtgaggccgggagaccgtgtgctggccatgggggaggatgggagccccaccttcagcgatgtgctcattttcctggaccgcgagccccacaggctgagagccttccaggtcatcgagactcaggaccccccacgccgcctggcactcacacccgctcacctgctctttacggctgacaatcacacggagccggcagcccgcttccgggccacatttgccagccacgtgcagcctggccagtacgtgctggtggctggggtgccaggcctgcagcctgcccgcgtggcagctgtctctacacacgtggccctcggggcctacgccccgctcacaaagcatgggacactggtggtggaggatgtggtggcatcctgcttcgcggccgtggctgaccaccacctggctcagttggccttctggcccctgagactctttcacagcttggcatggggcagctggaccccgggggagggtgtgcattggtacccccagctgctctaccgcctggggcgtctcctgctagaagagggcagcttccacccactgggcatgtccggggcagggagctgaaaggactccaccgctgccctcctggaactgctgtactgggtccagaagcctctcagccaggagggagctggccctggaagggacctgagctgggggacactggctcctgccatctcctctgccatgaagatacaccattgagacttgactgggcaacaccagcgtcccccacccgcgtcgtggtgtagtcatagagctgcaagctgagctggcgaggggatggttgttgacccctctctcctagagaccttgaggctggcacggcgactcccaactcagcctgctctcactacgagttttcatactctgcctcccccattggggagggcccattccatccatcttaggcgcgcaaattacccactacctccccgggtcggagtgtatttgcgcgctctgctgccttcatgaaggcgatca

SEQ ID NO: 61796 - DNA, 410 bp, Homo sapiens
catttaatttggtgtatatttttaaaatgtcaaaagcagttaccataacttaattttataagcatataagggaagtatgttgcatattattgtgacttcttttaatacttcaagaaaattaataaatacactgttttctgttaaatctaataccctaaagtttaatagcaggtgaattattctgagcaattggaagaatacgagaaatagcgaaactgtattgcatgtgaagtctaattccacctggctgaatgtttcagcctattatccttcatattagatgttatgaatgtaatgtgtcataaataaccttacactaaccagcaagcctgtgtctgcagatgcaaaatgaagcgaaagattaaggcaatcaaaaagaaaattctaataaaatagtttcacctcaattt

SEQ ID NO: 61797 - DNA, 445 bp, Homo sapiens
tgctttttcattgctagccactaaagtccactacattttgggacagcttgtttgaagagatggtcattagattgtttctctatgcagaaaatttttgaattggcttattcaaaattgccaacgagaaattacatgtgttgcctggaaagggtatgatttaaaatttttaaagtctcattttagtcccttaaaaaacactttgaatgaagcagccgagtgctctggtgtgctaatggtcagcagagcggctcccagctccctcctgcagcagggcgtttggccgcagcccatggcaggagctggtggggccgcgtcaggcagccccaggcatgggtaccctttatgaataccttcctcgaatgcgaatgcgctggtcaggacaatttctatgtctggaattccaaacaaccagaccattaaaattcatgggaatgcaagtcaggca

SEQ ID NO: 61798 - DNA, 4584 bp, Homo sapiens
  misc_feature (3227)..(3227): n is a, c, g, or t
  misc_feature (4573)..(4574): n is a, c, g, or t
  misc_feature (4576)..(4578): n is a, c, g, or t
  misc_feature (4580)..(4581): n is a, c, g, or t
  misc_feature (4583)..(4583): n is a, c, g, or t
cggagaaagctccaaaagcaagccctgggccctgaacaaaatctagagacattattaaacctggcaacctcggtgttctataatagggaccaagaggaacaggtccaaaaggaaaagcgagatcagagaaaggccgcagccttagtcatggccctcagacaaacaaaccttggtggttcagagaggacagaacatgaagcaggccaatcacctggtaaggcttgttatcagtgtggtttactgggacactttaaaaaagattgtccaatgagaaacaagctgccccctcgtccgtgtccactatgctgaggcaatcactggaaggtgcactgccccagaggatgaaggttccctgggtcagaagcccccagccagacgatccaacaacaggactgagggtgcctggggcaagcgccagctcatgtcatcaccctcactgagccccgggtatgtttaactattgagggccaggaaattgacttcctcctggacactggcgcggccttctcagtgttaatctcctgtcctggacgactctcctcaaggtccgttaccatccaaggaatcctgggacagcctgtaaccaggtatttctcccacctcctcagttgtaattgggagactttgctcttttcacatgcctttcttgttatgcctgaaagtcccacagggttattagggagggatatattagccaaggctggagctattatctacatgaatatggggaacaagttacccatttgttgtcccctacttgaggagggaatcaaccctgaagtctgggcattggaaggacaatttggaagggcaaaaaatgcccacccagtccaaatcaggttaaaagatcccaccacttttccttatcaaaggcaatatccctaaggcctgaagctcataaaggattacagaatattgttaaacatttgaaagctcaaggcttagtaaggaaatgcagcagtccctgcaacaccccaattctggaagtacaaagaccgagactagtgcaagatcttagactcattaatgaggcagtaatttcactatatccagttgtacccaacccctataccctgctctctcaaataccagaggaagcagaatggttcacagttctggacctcaaggatgccttcttctgtgttcccctgcactctgattcacagttcctctttgcttttgaggatcccacaaaccacacatcccaacttacatggatggtcttgccccaagggtttagggatagccctcatctgtttggtcaggccctagccaaagatctaggccacttctcaagtccaggcactctggtccttcaatatgtggatgatttacttttggctaccagttaggaagccttgtgccagcaggctactctagatctcttgaactttctagctaatcaagggtacaaggtgtctatgtcgaaggcccagctttgcctacagcaggttaaatatctaggcctaatcttagccaaagggaccagggccctcagcaaggaatgaatacagcctatactggcttatcctcgccctaagacattaaaacagttgagggagttccttggaattaccagcttttgccgactatggatccctggatacagcgagacagccaggcccctctaatcaaggaaacccagagggcaaatactcatctagttgagtgggaaccagaggcagaaacaaccttcaaaaccttaaagcaggctctagtacaagctccagctttaagccttcccacaggacagaatttctctttatatgtcagagagagagccaggatagctcttggagtcctcactcaaactcatgggacaaccccacaaccagtggcatacctaagtaaggaaattgatgtagtagcaaaaggctggcctcactgtttaagggtagttgcagcagtggccgtcttagcatcagaggctatcaaaataatacaaggaaaggatctcactgtctagactacttatgatgtaaatggcatactaggtgccaaaggaagtttatggctatcagacaactgcctacttagataccaggcactactccttgagggaccagtgcttcaaatatgcacatgcatggccctcaaccctgccacttttctcccagaggatggggaaccaatcaagcatgactgccaacaaattatagtccagacttatgccgcccgagatgatctcttagaagtccccttaactaatcctgaccttaacctatatactgatggaagttcatttgtggagaatgggatacgaaggttagtgatgtaaccatacttgaaagcaagcctcttcccccagggaccagtgcccagttagcggaactagtggcacttacctgggccttagaactgggaaagggaaaaagaataaatgtgtatacagatagcaagtatgcttatctaatcctacatgcccatgctgcaatatggaaagagagggagttcctaacctctgtaggaacccccattaaataccacaaggaaattatagagttattgcacgcaatgcaaaaacacaaagaggtgggaatcttacactgacaaagccatcagaataggaaggagaggggagaacagcagcataagcagctggcagaggcagcagaaaggaaagaaagagacaggaagtcaaagaaagagacagagaggaagagacaagaagttagagagaaagagggacagacacagaaagtcaaagagagggtaaaaaagagaggaagagacaaagaagaagtcaaagagagagatggaagtagtaaagaaaaaacagtgtacctattcctttaaaagccagggtaaatttctctctacccacgcaaggcatattctcttatgtggatcttcaacccatatctgcctctcaaacagttggaagaaataatgaaatctatccttactttacaatcccaaatagactctttggcagcagtgactctccaaaaccgctgaggcctagatctcctcactgctgaaaaaggaggactctgcaccttcttaggggaagagtgttgtttttacactaaccagtcagggatagcatgagatgccacccagcgtttacaggaaaaggcttctgaaatcagacgcctttcaaattcttataccaacctctggagttgggcaacatggcttctcccctttctaggtcccgtggcagccatcttgctgttactcgcctttgggccccgtatttttaaccttcttgtcaaatttgtttngtctagaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattcccaacagcagttggggtgtcctgttgattgaggggtgacagcatgctggcagtcctcacagccctcactcgctcgctcactctcggcacctcctctgcctgggctcccactttggcagcacttgaggagcccttcagctctgtatctagctactctgatgggtccttggagaacctttatgtctagctcagggattgtaaatacaccaatcagcaccctgtgtctagctcagggtttgtgaatgcaccaatggacactctgtatctagctactctggtggggccttggagaacctttgtgtcaacactctgtatctaactaacctggtggggatgtggagaacctttgtgtctagctcagggatgtaaacgcaccaatcagtgccctgtcaaaccactcggctctaccaatcagcaggatgtgggtggggccagataagagaataaaagcaggctgcccgagccagcagtggcaacccgctcaggtccccttccacactgtggaagctttgttctttcgctctttgcaatacatcttgctactgctcactctttgggtccacactgcttttatgagctgtaacactcaccacaaaggtctgtagcttcactcctgagccagcgagaccacgaactcaccagaaggaagaaactccaaacacatccgaacatcagaagaaacaaactccagacgcaccaccttaagagctgtaacactcactgtgagggtccatggcttcattcttgaagtcagtgagaccaagaacccaccaattccggacacacaaccggccatgtgacaggctcagggaaggacatgtgactcaaggcaggccagtgaagtgcaattctaggttagactggccgggaaggagcggccgtgttttctgttgatggatgctgctgccctctcctcaacctctcacactctgcactacagacaacctccttggggctgaggccagcacagcgcaaagcacagcaagaggggagcccgagcccctggatccagccatcctccacggcaagctcagaccacccgctccctcagctctttcacagaaccctggtctacctagttgatgtcttatataattccactattatctgtgattaattaatgtggaaccacatgannannngnntnc

SEQ ID NO: 61799 - DNA, 1893 bp, Homo sapiens
  misc_feature (2)..(3): n is a, c, g, or t
  misc_feature (5)..(5): n is a, c, g, or t
  misc_feature (1882)..(1883): n is a, c, g, or t
  misc_feature (1885)..(1887): n is a, c, g, or t
  misc_feature (1889)..(1890): n is a, c, g, or t
  misc_feature (1892)..(1892): n is a, c, g, or t
gnntncccttccacactgtggaagctttgttctttcactctttgcaataaatcttgctactgttcactctttgggtccacactgcttttatgagctataacactcaccgcaaaggtctgcagcttcactcctgaagccagcgagaccacaagcccactgggaggaacgaacaactccaggcgcgcaatgaacaactccaggcgcgccgccttaagagctgtaacatcaccgcgaaggtctgcagtttcactcctaagccagcgagaccacgaacccaccagaaggaagaaactccaaacacatctgaacattagaaggaacaaactccagatgcgcacctttaagagcttgtaacactcaccgcgagggtccacggcttcattcttgaagtcaagtgatgaaggatgcaagaacccaccaattccggacacattttgtcgaccatgaaggactttcgcctattgccaagcggtgagacaatcgctgagcagtgagaccatcacctattgccgagcggtgagaccattgcctatcgccaagcaaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattcccaacagcagttggggtgtcctgttgattgaggggtgacagcatgctggcagtcctcacagccctcactcgctcgctcactctcggcacctcctctgcctgggctcccactttggcagcacttgaggagcccttcagctctgtatctagctactctgatgggtccttggagaacctttatgtctagctcagggattgtaaatacaccaatcagcaccctgtgtctagctcagggtttgtgaatgcaccaatggacactctgtatctagctactctggtggggccttggagaacctttgtgtcaacactctgtatctaactaacctggtggggatgtggagaacctttgtgtctagctcagggatgtaaacgcaccaatcagtgccctgtcaaaccactcggctctaccaatcagcaggatgtgggtggggccagataagagaataaaagcaggctgcccgagccagcagtggcaacccgctcaggtccccttccacactgtggaagctttgttctttcgctctttgcaatacatcttgctactgctcactctttgggtccacactgcttttatgagctgtaacactcaccacaaaggtctgtagcttcactcctgagccagcgagaccacgaactcaccagaaggaagaaactccaaacacatccgaacatcagaagaaacaaactccagacgcaccaccttaagagctgtaacactcactgtgagggtccatggcttcattcttgaagtcagtgagaccaagaacccaccaattccggacacacaaccggccatgtgacaggctcagggaaggacatgtgactcaaggcaggccagtgaagtgcaattctaggttagactggccgggaaggagcggccgtgttttctgttgatggatgctgctgccctctcctcaacctctcacactctgcactacagacaacctccttggggctgaggccagcacagcgcaaagcacagcaagaggggagcccgagcccctggatccagccatcctccacggcaagctcagaccacccgctccctcagctctttcacagaaccctggtctacctagttgatgtcttatataattccactattatctgtgattaattaatgtggaaccacatgannannngnntnc

SEQ ID NO: 61800 - DNA, 1219 bp, Homo sapiens
  misc_feature (2)..(3): n is a, c, g, or t
  misc_feature (5)..(5): n is a, c, g, or t
gnntncccttccacactgtggaagctttgttctttcactctttgcaataaatcttgctactgttcactctttgggtccacactgcttttatgagctataacactcaccgcaaaggtctgcagcttcactcctgaagccagcgagaccacaagcccactgggaggaacgaacaactccaggcgcgcaatgaacaactccaggcgcgccgccttaagagctgtaacatcaccgcgaaggtctgcagtttcactcctaagccagcgagaccacgaacccaccagaaggaagaaactccaaacacatctgaacattagaaggaacaaactccagatgcgcacctttaagagcttgtaacactcaccgcgagggtccacggcttcattcttgaagtcaagtgatgaaggatgcaagaacccaccaattccggacacattttgtcgaccatgaaggactttcgcctattgccaagcggtgagacaatcgctgagcagtgagaccatcacctattgccgagcggtgagaccattgcctatcgccaagcaaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattcccaacagcagttggggtgtcctgttgattgaggggtgacagcatgctggcagtcctcacagccctcactcgctcgctcactctcggcacctcctctgcctgggctcccactttggcagcacttgaggagcccttcagctctgtatctagctactctgatgggtccttggagaacctttatgtctagctcagggattgtaaatacaccaatcagcaccctgtgtctagctcagggtttgtgaatgcaccaatggacactctgtatctagctactctggtggggccttggagaacctttgtgtcaacactctgtatctaactaacctggtggggatgtggagaacctttgtgtctagctcagggatgtaaacgcaccaatcagtgccctgtcaaaccactcggctctaccaatcagcaggatgtgggtggggccagataagagaataaaagcaggctgcccgagccagcagtggc

SEQ ID NO: 61801 - DNA, 2468 bp, Homo sapiens
  misc_feature (1111)..(1111): n is a, c, g, or t
  misc_feature (2457)..(2458): n is a, c, g, or t
  misc_feature (2460)..(2462): n is a, c, g, or t
  misc_feature (2464)..(2465): n is a, c, g, or t
  misc_feature (2467)..(2467): n is a, c, g, or t
tggctaggtcgaggccgcgtggtaatcggccgagaaattatagtccagacttatgccgcccgagatgatctcttagaagtccccttaactaatcctgaccttaacctatatactgatggaagttcatttgtggagaatgggatacgaaggttagtgatgtaaccatacttgaaagcaagcctcttcccccagggaccagtgcccagttagcggaactagtggcacttacctgggccttagaactgggaaagggaaaaagaataaatgtgtatacagatagcaagtatgcttatctaatcctacatgcccatgctgcaatatggaaagagagggagttcctaacctctgtaggaacccccattaaataccacaaggaaattatagagttattgcacgcaatgcaaaaacacaaagaggtgggaatcttacactgacaaagccatcagaataggaaggagaggggagaacagcagcataagcagctggcagaggcagcagaaaggaaagaaagagacaggaagtcaaagaaagagacagagaggaagagacaagaagttagagagaaagagggacagacacagaaagtcaaagagagggtaaaaaagagaggaagagacaaagaagaagtcaaagagagagatggaagtagtaaagaaaaaacagtgtacctattcctttaaaagccagggtaaatttctctctacccacgcaaggcatattctcttatgtggatcttcaacccatatctgcctctcaaacagttggaagaaataatgaaatctatccttactttacaatcccaaatagactctttggcagcagtgactctccaaaaccgctgaggcctagatctcctcactgctgaaaaaggaggactctgcaccttcttaggggaagagtgttgtttttacactaaccagtcagggatagcatgagatgccacccagcgtttacaggaaaaggcttctgaaatcagacgcctttcaaattcttataccaacctctggagttgggcaacatggcttctcccctttctaggtcccgtggcagccatcttgctgttactcgcctttgggccccgtatttttaaccttcttgtcaaatttgtttngtctagaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattcccaacagcagttggggtgtcctgttgattgaggggtgacagcatgctggcagtcctcacagccctcactcgctcgctcactctcggcacctcctctgcctgggctcccactttggcagcacttgaggagcccttcagctctgtatctagctactctgatgggtccttggagaacctttatgtctagctcagggattgtaaatacaccaatcagcaccctgtgtctagctcagggtttgtgaatgcaccaatggacactctgtatctagctactctggtggggccttggagaacctttgtgtcaacactctgtatctaactaacctggtggggatgtggagaacctttgtgtctagctcagggatgtaaacgcaccaatcagtgccctgtcaaaccactcggctctaccaatcagcaggatgtgggtggggccagataagagaataaaagcaggctgcccgagccagcagtggcaacccgctcaggtccccttccacactgtggaagctttgttctttcgctctttgcaatacatcttgctactgctcactctttgggtccacactgcttttatgagctgtaacactcaccacaaaggtctgtagcttcactcctgagccagcgagaccacgaactcaccagaaggaagaaactccaaacacatccgaacatcagaagaaacaaactccagacgcaccaccttaagagctgtaacactcactgtgagggtccatggcttcattcttgaagtcagtgagaccaagaacccaccaattccggacacacaaccggccatgtgacaggctcagggaaggacatgtgactcaaggcaggccagtgaagtgcaattctaggttagactggccgggaaggagcggccgtgttttctgttgatggatgctgctgccctctcctcaacctctcacactctgcactacagacaacctccttggggctgaggccagcacagcgcaaagcacagcaagaggggagcccgagcccctggatccagccatcctccacggcaagctcagaccacccgctccctcagctctttcacagaaccctggtctacctagttgatgtcttatataattccactattatctgtgattaattaatgtggaaccacatgannannngnntnc

SEQ ID NO: 61802 - DNA, 3910 bp, Homo sapiens
  misc_feature (3227)..(3227): n is a, c, g, or t
cggagaaagctccaaaagcaagccctgggccctgaacaaaatctagagacattattaaacctggcaacctcggtgttctataatagggaccaagaggaacaggtccaaaaggaaaagcgagatcagagaaaggccgcagccttagtcatggccctcagacaaacaaaccttggtggttcagagaggacagaacatgaagcaggccaatcacctggtaaggcttgttatcagtgtggtttactgggacactttaaaaaagattgtccaatgagaaacaagctgccccctcgtccgtgtccactatgctgaggcaatcactggaaggtgcactgccccagaggatgaaggttccctgggtcagaagcccccagccagacgatccaacaacaggactgagggtgcctggggcaagcgccagctcatgtcatcaccctcactgagccccgggtatgtttaactattgagggccaggaaattgacttcctcctggacactggcgcggccttctcagtgttaatctcctgtcctggacgactctcctcaaggtccgttaccatccaaggaatcctgggacagcctgtaaccaggtatttctcccacctcctcagttgtaattgggagactttgctcttttcacatgcctttcttgttatgcctgaaagtcccacagggttattagggagggatatattagccaaggctggagctattatctacatgaatatggggaacaagttacccatttgttgtcccctacttgaggagggaatcaaccctgaagtctgggcattggaaggacaatttggaagggcaaaaaatgcccacccagtccaaatcaggttaaaagatcccaccacttttccttatcaaaggcaatatccctaaggcctgaagctcataaaggattacagaatattgttaaacatttgaaagctcaaggcttagtaaggaaatgcagcagtccctgcaacaccccaattctggaagtacaaagaccgagactagtgcaagatcttagactcattaatgaggcagtaatttcactatatccagttgtacccaacccctataccctgctctctcaaataccagaggaagcagaatggttcacagttctggacctcaaggatgccttcttctgtgttcccctgcactctgattcacagttcctctttgcttttgaggatcccacaaaccacacatcccaacttacatggatggtcttgccccaagggtttagggatagccctcatctgtttggtcaggccctagccaaagatctaggccacttctcaagtccaggcactctggtccttcaatatgtggatgatttacttttggctaccagttaggaagccttgtgccagcaggctactctagatctcttgaactttctagctaatcaagggtacaaggtgtctatgtcgaaggcccagctttgcctacagcaggttaaatatctaggcctaatcttagccaaagggaccagggccctcagcaaggaatgaatacagcctatactggcttatcctcgccctaagacattaaaacagttgagggagttccttggaattaccagcttttgccgactatggatccctggatacagcgagacagccaggcccctctaatcaaggaaacccagagggcaaatactcatctagttgagtgggaaccagaggcagaaacaaccttcaaaaccttaaagcaggctctagtacaagctccagctttaagccttcccacaggacagaatttctctttatatgtcagagagagagccaggatagctcttggagtcctcactcaaactcatgggacaaccccacaaccagtggcatacctaagtaaggaaattgatgtagtagcaaaaggctggcctcactgtttaagggtagttgcagcagtggccgtcttagcatcagaggctatcaaaataatacaaggaaaggatctcactgtctagactacttatgatgtaaatggcatactaggtgccaaaggaagtttatggctatcagacaactgcctacttagataccaggcactactccttgagggaccagtgcttcaaatatgcacatgcatggccctcaaccctgccacttttctcccagaggatggggaaccaatcaagcatgactgccaacaaattatagtccagacttatgccgcccgagatgatctcttagaagtccccttaactaatcctgaccttaacctatatactgatggaagttcatttgtggagaatgggatacgaaggttagtgatgtaaccatacttgaaagcaagcctcttcccccagggaccagtgcccagttagcggaactagtggcacttacctgggccttagaactgggaaagggaaaaagaataaatgtgtatacagatagcaagtatgcttatctaatcctacatgcccatgctgcaatatggaaagagagggagttcctaacctctgtaggaacccccattaaataccacaaggaaattatagagttattgcacgcaatgcaaaaacacaaagaggtgggaatcttacactgacaaagccatcagaataggaaggagaggggagaacagcagcataagcagctggcagaggcagcagaaaggaaagaaagagacaggaagtcaaagaaagagacagagaggaagagacaagaagttagagagaaagagggacagacacagaaagtcaaagagagggtaaaaaagagaggaagagacaaagaagaagtcaaagagagagatggaagtagtaaagaaaaaacagtgtacctattcctttaaaagccagggtaaatttctctctacccacgcaaggcatattctcttatgtggatcttcaacccatatctgcctctcaaacagttggaagaaataatgaaatctatccttactttacaatcccaaatagactctttggcagcagtgactctccaaaaccgctgaggcctagatctcctcactgctgaaaaaggaggactctgcaccttcttaggggaagagtgttgtttttacactaaccagtcagggatagcatgagatgccacccagcgtttacaggaaaaggcttctgaaatcagacgcctttcaaattcttataccaacctctggagttgggcaacatggcttctcccctttctaggtcccgtggcagccatcttgctgttactcgcctttgggccccgtatttttaaccttcttgtcaaatttgtttngtctagaatcgaggccatcaagctacagatggtcttacaaatggaaccccaaatgagttcaactaacaacttctaccgaggacccctggactgaccagctggcacttcccctggcctagagagttcccctctgaaggacactacaactgcaaagccccttcttcgcccctatccagcaggaagtagctagagcagtcatcggccaaattcccaacagcagttggggtgtcctgttgattgaggggtgacagcatgctggcagtcctcacagccctcactcgctcgctcactctcggcacctcctctgcctgggctcccactttggcagcacttgaggagcccttcagctctgtatctagctactctgatgggtccttggagaacctttatgtctagctcagggattgtaaatacaccaatcagcaccctgtgtctagctcagggtttgtgaatgcaccaatggacactctgtatctagctactctggtggggccttggagaacctttgtgtcaacactctgtatctaactaacctggtggggatgtggagaacctttgtgtctagctcagggatgtaaacgcaccaatcagtgccctgtcaaaccactcggctctaccaatcagcaggatgtgggtggggccagataagagaataaaagcaggctgcccgagccagcagtggc

SEQ ID NO: 61803 - DNA, 583 bp, Homo sapiens
tctagttagctcacccacagcctccagatgccaacagcctttgatcaaggctcacctgaagcctccccttttcccagcataaagctttctcactccgctgactgcctttgagtgtctgcaatggcaagtgactgtggctgactctctgtgtatataccacactgagaataagtagctgctgctcattttcatttgggtggtctataattattactgaagtgaagtgtgatcacagttaaggtggtaatagtcagaccctttacactgttgatggactcagactttttacttcatgccttgcttatactgcttggatgttttccatgtgcctatattaatatttacaataaaagcatgatttagattttcatttagaatttatcttaaatgcatcaaatatgcaattttaagtcaagttttgcatgtttggctcaaaatatcaaaataatgttgtgtggttttaaaataacaaggtttattgctctttatattagacatgtagttaattacgttgatctccataaaaataagtttaattttaatttgaataaaagaatgccacaatgaaatactgaccattaaa

SEQ ID NO: 61804 - DNA, 584 bp, Homo sapiens
caggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaaaaaaaaa

SEQ ID NO: 61805 - DNA, 2023 bp, Homo sapiens
  misc_feature (1220)..(1220): n is a, c, g, or t
  misc_feature (1336)..(1336): n is a, c, g, or t
tagatgaaatcctttttcgggccaaactcaattgttttaacttaaaaaaaaattcattcagtttaagataaaataatgcttccttaataaaactaaaaacaaaaagcatctttagaagctgtgtagcgtactttatttatttatttatttggagacagggtctcactctgttgcccaggctggagtacagtggcacagtctcagttcattgcaacctccgcctcccgggttaaagcgattctcctgccttagcctcatgagtgactgagactacaagtgtggaccaccacgcctggctaattttggtatttttttggtagagacagagtttcaccatattggctaggctgttctgttgaccatgaggcaccatacctgggctgtgtagcagacttaaaaaaataagatttgaagttagaacttaaggctttgggccaattaatagttttgtttgtttgtttgcggcggaatctcgctctttcacccaggctggagtgcagtggcgcgatcttggctcactgcagcctctgcctcttgggtttaaggagtcctcctgcctcagcctcctaagtagctgggactacaggcgcatgccaccacacctggctaatttttgtatttttagtagagatggggtttccccatgttggccaggctgttctcaaactcttgacttcaggtaatcctcctgactcagcctcccaaagtgctgggattacaggcgtgagccatcacgcccagccccagttaatggttgtgttaccttgagcaattcacttaatctctgagactcagtttgctcatttgtaaaatggtgatcatcataatatatacctcttatagttattaggaaattaaatggtaatgtatatataaagcataagcataatgtttgatgtgtattaaatactcaaatgtagctcctgttattatcagaggactccttacactgtaaatacatgctacaaaaattttagaatgcactttatcaggcattttagtacaaataagcaaaacagttgatcttgtagactaattttgaagtttcatattggttccagttcaagcactgtatataaaatatccagaataattcactatattaattagtttaatactgtcttagtctattcaggctgctctaataaaatatcataaactggatggcttataaacaatagaaatttatttctcacagttcacatttaggaagtcccatntcaagaggctaacagatttggtgtctagtttggtgccctagtgagggtttgctcttctggttcatagatggtgctttcttgttgtgtcctcacatgatggatagcacaaacaagcncccttaggccccttttataagggcactaaccccgttcacaggggctctgccctcatatccaatcacctcctaaaggccccatctcttaatactgttgcattggggattaggtttcaatatatgacttttgagggaacacaaacattcagatcataacaaatgtgaaaatgaattaatctttaggaaaattggtggcactttttgtgtatcctagtaagaagtttggttactgggtaataagtctgttgaaaagattataatttaacaaaatgtgaaaattatggtaatatttatgaagatttttttaaagcagcatatcagattctttctcacattttatattggtgtggttggtgtttttcttatggggagaaatactagtaagtgaactatatagacatttaaaattaacatgagttaaatccattataaattttagaaaaccatttattctacagtagtttccaaaactggggtatacctatcccaagctatacactaagatttttcaggatatataaaggcacagagagctttaagggaatctgtttctagtcttcggagatcttgtttatgttttttgcattgtcttttccaaagtctcttacttgttaccttttgctgttatgtatttcccattatgcattgatccaagatgtaaaaacctctagggcaccaaacaggaaa

SEQ ID NO: 61806 - DNA, 503 bp, Homo sapiens
gataaccaagtttatacaaccctgcaatacttaagagactccactaaaaagtgtcacggaatgaccatggtcgtccatttatttattacatcatcatacatcttttggaagccaggtcctgatatcacttctctagtgataacaagcaaaaaagcaatttaaaagacatagcatgttttttttttttctacagaagaccatgtaaaatttatctgcttattggaattctgagtaaacttttctatttctaacatattccaggaaatcacacaagaatgtttgcttgtggaatttctgactcttgttcttggatgatatactgtgatgtcaataatatttgcagctaccgcatgagcatcttttcctccagattcttaagtaagaatctaaggataaggaaaaggtgtcttttctctgaccatataagcacatcaaaatgaagttgccacaatgagtttttcatccttaaaataaatgagtttttcaaacaaatcagcaagaaa

SEQ ID NO: 61807 - DNA, 1028 bp, Homo sapiens
tagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaattttttttgttgttgtattaaaccatgtacgttgcagcttaacaataaaaaaaaatctatgaatctttgtgagcaattatgctcccaaatctaagcaagtaaaatacacattttgtctttttgtctttcttaattggagtt

SEQ ID NO: 61808 - DNA, 615 bp, Homo sapiens
ggttttctaaatctttttctcattagaggaccatattgaacgataacattatttatctataacagcgtttttctacaatggacatagctgttcaaatgtttctctttttgtgagagtatcttgggggttttattaatactccacccccatctccattcctaccggcaaaaacagcaaaggcactagaaccttcattgatgactgtctggattggtagtataatgtatttctggaaagtacttcttaaaaaatatttttctactttggattttttttttttttttatccattcgcagacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaaggtaaagggattaggaagaaaggattagagttactgatgcacacctctgaactggattatgattcacacctttatatcggcgtggatgaaaataactagaccaagaaagttgttctcatttttgtaattaacatgtaaatatttagttattctccc

SEQ ID NO: 61809 - DNA, 1076 bp, Homo sapiens
tacccgacgctctctctgacgctctctctgtgggggacgctctctctgtgggtgacgctctctctgtggggggagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaattttttttgttgttgtattaaaccatgtacgttgcagcttaacaataaaaaaaaatctatgaatctttgtgagcaattatgctcccaaatctaagcaagtaaaatacacattttgtctttttgtctttcttaattggagtt

SEQ ID NO: 61810 - DNA, 1052 bp, Homo sapiens
tacccgacgctctctctgacgctctctctgtgggggacgctctctctgtgggtgacgctctctctgtggggggagaagccgcagcgccgcctcttctctcgcgccctcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaattttttttgttgttgtattaaaccatgtacgttgcagcttaacaataaaaaaaaatctatgaatctttgtgagcaattatgctcccaaatctaagcaagtaaaatacacattttgtctttttgtctttcttaattggagtt

SEQ ID NO: 61811 - DNA, 866 bp, Homo sapiens
  misc_feature (833)..(833): n is a, c, g, or t
tagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccanggttttggtggtggatccatggacgttgcgctt

SEQ ID NO: 61812 - DNA, 974 bp, Homo sapiens
tagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataatggaaaatgttttgagtgtttattgttcagtttattacgtttcacttgattaaattttttttgttgttgtattaaaccatgtacgttgcagcttaacaataaaaaaaaatctatgaatctttgtgagcaattatgctcccaaatctaagcaagtaaaatacacattttgtctttttgtctttcttaattggagtt

SEQ ID NO: 61813 - DNA, 1050 bp, Homo sapiens
ggattataggagacaaaatctgtttctctaaatatgatctagcttactgaaatggttaattctgttcatacggtgaaataaaacctcatagtagttgactaaattttgttgtatatttatgcacttttccagaaatttgcctgtaatggtactgtgattgaacatcctgaatacggagaggttattcagcttcaaggtgaccaaagaaaaaacatctgccagtttctcttggaggtgagtgattgggtgctttatgtgtaaccttgagattgcttttaaaattgtatttaaaggcaacatgatttgttttctactaagtaaaaagcaaagacctttatctggtttattttgtcattagagtattctgatcatttctgtatatacacacacaggctatttcttggcatgtaaagtattcaaatacgtgttgaattgttggctatcagcagtgcatgccacagacaacagtgttgcagtaagctgttgatagtgattctttttaattactcttccatgttttcttaatgaatttttatatttctcagagttattttgctaaattagattttattttacaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaattttttttgttgttgtattaaaccatgtacgttgcagcttaacaataaaaaaaaatctatgaatctttgtgagcaattatgctcccaaatctaagcaagtaaaatacacattttgtctttttgtctttcttaattggagtt

SEQ ID NO: 61814 - DNA, 519 bp, Homo sapiens
  misc_feature (169)..(169): n is a, c, g, or t
  misc_feature (171)..(171): n is a, c, g, or t
cgagggtgtctttctgccgttccgttgctggattcttatatgaatgtaatcctcagtcctgccgggagtaagtcgtcacccttagttgcatcagcaaaggggtcgaaagattggaggttctggatagtggacatgcgatactagtgtgaggccggtgaggggataaaantnctgcggtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaattttttttgttgttgtattaaaccatgtacgttgcagcttaacaataaaaaaaaatctatgaatctttgtgagcaattatgctcccaaatctaagcaagtaaaatacacattttgtctttttgtctttcttaattggagtt

SEQ ID NO: 61815 - DNA, 835 bp, Homo sapiens
tacccgacgctctctctgacgctctctctgtgggggacgctctctctgtgggtgacgctctctctgtggggggagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcggtaagatcccgtcgccgccgcctccctcccttgcccggcgcgcatctcggccttttgcccgcctggccaccgcccctaggggccccctttctgcccttcccgcacccctagtggggctttgtctcggcgcccagaaaatggcgacggggcccctggcgaccccttccccgaggacagcgccggactccgagccctcctctcggagccccggccgcgggccctgcgccaccccctgccccgtccttgacccggctctcgcctccgcttctgccccttgaaaccttggcgatcctatttcgtggactcctagatcggccctgctacttgcaaagggtatgccgggccagggaaaccagggatcggcgcccgttctctggcagctcctgggggcacttagggaaagatgcggatgcaagcctctgatctgtcactggccagtggttcagtcttctctgcttgcgtagcaatttgttaaattacgcctcttgatatatatg

SEQ ID NO: 61816 - DNA, 949 bp, Homo sapiens
tagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaattttttttgttgttgtattaaaccatgtacgttgcagcttaacaataaaaaaaaatctatga

SEQ ID NO: 61817 - DNA, 875 bp, Homo sapiens
tagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccactggcttgtcgtgcataaaccatgtacgtggagcttaacataa

SEQ ID NO: 61818 - DNA, 1372 bp, Homo sapiens
tagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaagcgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgaccaaagaaaaaacatctgccagtttctcttggaggtgagtgattgggtgctttatgtgtaaccttgagattgcttttaaaattgtatttaaaggcaacatgatttgttttctactaagtaaaaagcaaagacctttatctggtttattttgtcattagagtattctgatcatttctgtatatacacacacaggctatttcttggcatgtaaagtattcaaatacgtgttgaattgttggctatcagcagtgcatgccacagacaacagtgttgcagtaagctgttgatagtgattctttttaattactcttccatgttttcttaatgaatttttatatttctcagagttattttgctaaattagattttattttacaggttggcattgtaaaggaggaacagcttaaggttcatggattctaaaatgaacctaaatacgtggagaatttcttgaatagttttgttctctaaacccggtttggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaattttttttgttgttgtattaaaccatgtacgttgcagcttaacaataaaaaaaaatctatgaatctttgtgagcaattatgctcccaaatctaagcaagtaaaatacacattttgtctttttgtctttcttaattggagtt

SEQ ID NO: 61819 - DNA, 417 bp, Homo sapiens
gtctactcccactgctttttccaggcacatacatcacaatcatggctgactcttaaagtcaagaaggaattcaataaagttacaggatataaaaatcagttgtgtttctatacgacaacaaaatagacaaaaagaaaattaatttcatttataatggcatcaaaaaatacttaggcataaacttaaacaagcaggtgaaagatttatacattgaaaactataaaacgttgatgaaagaaattaaaagacacaaatggaaacacatgctgtgttcatgaattagaagacttaatattgctaatatgtccatactagcaaagtaaaattccaacggcattttttacaaaaatagaaaaggcaatcccaaaattcatatggaaccacaaaagaccaagaatagccaaagctatctggagg

SEQ ID NO: 61820 - DNA, 9090 bp, Homo sapiens
cgagcccagtcgagccgcgctcacctcgggctcccgctccgtctccacctccgcctttgccctggcggcgcgaccccgtcccggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcgcacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacgcagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaaaa

SEQ ID NO: 61821 - DNA, 8780 bp, Homo sapiens
cgagcccagtcgagccgcgctcacctcgggctcccgctccgtctccacctccgcctttgccctggcggcgcgaccccgtcccggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcgcacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacgcagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcgtttagggtgagtgtacgcggttagggtgtagttatcacgattag

SEQ ID NO: 61822 - DNA, 1048 bp, Homo sapiens
gccagaactttcctggcatttcctttcacatgaatcttgaaacaaaaaccaactaagtataaattagtctctctttcacctcctgcagtctttattcaatccagacccattatttctgcctctccaagtacacacccacatattttatgtttgctaaaacatttgaagacaatctttaataaagtacaggtatacctcgtcttactgttcttgacattattacacttcacagatattgtggtttttataaattgaaggtttatggcaaccctgcattgatcaagtctattagcaccatttttcctacagcatatgctcactttatgtctctggacactggaagaagatgccatctagaactttcatagctagagaggagaaggtcaatgcctagcttcaaaggacaggctgactcttttgttaggagctaacaaattgccacagcaattttgataattctcataatatttcaaaactttatattgttattaactgctatggtgggctttgatcagtgatctttgttattactgtaatcatttcagggcaccacaaactgtacccatgtaggacaacagacttaactgatcaatgtcgtgtgcgttctgactgctccactgaccatctattccctcatctctcttcctctcctcaggctcccctattccctgagatacaacaagattgaaattaggtcagttaataaccctacagtggcttttaaatgttcaagtgaatgggagagttacacatctctcagtttattttaaaaactagaaatgagccaggtatcatggctcattcctgcgaccccagcactttgggaagttaaagcgggaggattgcttgaggccaggagttccagaccaaggtctgcgcaacatagtgagactccatctctacaaaaaaatttaaaagttagtcaagcatggtggtgcacacctgtagtctgtagtcccagctacttaagaggctgaattcaaggctgcagtgagcgatgatcgtgccactgcacttcaacctgggtgacagaacaagaccttgtctc

SEQ ID NO: 61823 - DNA, 357 bp, Homo sapiens
tgcaatggcatgatcatagctcataactctggggctcaaacaatcctcccgcattggcctttcaaagtgctgggattacaggtgtgagccaccatgcccagcttgtgttagatttttttattctttggaaatttttgatttccagaatgaaattgctgatcatttaaaaaatatatatatacatatatgtgtgtgtgtgtgtgtgtgtgtgtgtgtgtgtttataagagtgaaatgtaggcatctataaagatgatcaagatatgatcaaggtcaaaattgttgactttctggagaattcatacaaagcccttttacataccacatcacattgcatttcactgaaagatggagggta

SEQ ID NO: 61824 - DNA, 754 bp, Homo sapiens
tagcgttctgaggatcccctcatgtctgacccacccgcggaggaaggagtgtaggaggaagcagatttttaaatattataaacattgaatagtgtaatttgccatcacttaagtaagttttccagctgatgataaactttacttggtaagacaagttttttgcattggccttcagtaaaatctttcacttagttgaaagcatttttatatggggaggagatgtaactaaggcaatctaggtttgtgattttctattacagtttgatccaagaaaaaatatcagtaagtgtgtcaatattatcttgtttagatcagtgttttgaaacttgtgtgttcgtaagaactgcctggggcccttgttaaaatacagattccaatgccagctgcagatttactgaatcagagtctctaggcaaggggcctgggtgtgtatttatcaaaggcaccaagtgatttcttatgctcaaacaggtttaaggaacactgctgtagatggttctccttgactgttttttttcctctcagctgggctttgtagcagtcattttgagtataaattgtgataggagcctgaggcaatagcattaaaagtgagttggcaaagcccagcagagccagtttaattagctagtttggataactgtaatgtcatttccccttctcaagctgtggtgcttcaggatgctgcccatcaagttccttcatccttccagtcttttcatctgttattccattgatccttacaccatctctg

SEQ ID NO: 61825 - DNA, 234 bp, Homo sapiens
gcagcagtttctttgaaaatttggaccagaaggtgcataacaagttgttctgcagaagttcttatctgatattcttagggagctatcctgcatgtaatcttcattttttttttctctaccatcatgtaggcatactcagtgtagactaccacaatcctggatacctctctgcttagatttacaatctctgctaagatttgccactgcagaaagtgtagtagtttcactacatat

SEQ ID NO: 61826 - DNA, 767 bp, Homo sapiens
  misc_feature (4)..(4): n is a, c, g, or t
gganccccactagcccacggttggctagtctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaataaaaaagt

SEQ ID NO: 61827 - DNA, 577 bp, Homo sapiens
  misc_feature (11)..(11): n is a, c, g, or t
  misc_feature (27)..(27): n is a, c, g, or t
  misc_feature (30)..(30): n is a, c, g, or t
ccccccccccnccttcactttgttgcncanccaattaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaataaaaaagt

SEQ ID NO: 61828 - DNA, 4712 bp, Homo sapiens
accggggcctcagccatggcgaccgtgctgtccagggcgctcaagctgccggggaagaagagcccagacctaggggagtatgatccacttacccaggctgacagtgatgagagcgaagacgatctggtgcttaacctgcagaagaatggaggggtcaaaaatgggaagagtcctttgggagaagcgccagaacccgactcagatgctgaggttgcagaggctgcaaagccacatctttcagaagtcaccacggagggctacccctcagaaccccttgggggcctggaacagaaggcggcctcctccctggtgtcatatgtgcgcacgtctgtcttcctgctgactttggggatctcgatgatcctggtgctcctgtgtgctttcctgatcccctgtcctcccagagatctgcacagcacctggagccgccacttgggctcccagggagaggtggggacctgtctccattggaattggctgatgtgaatggagatggcctgcgtgatgtgcttctctcctttgtgatgtcaaggaacgggagtgcagtaggtgtctcaagaccagctgctaatcttgtatgcctttcggggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagacttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggatcgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcagataatccacctgcttctgcctcccaaagtgctgggattacaggcgtgagccaccatgcccggctgggcttgtatcttttagcttgtgttagtaaaaggattctagaaaattatgaagtccagattcaaagggatctctgttaattacccactgacaggcattatgacctaacaggaggttggtagcagtagatccaagcatgcatgttgcctggcctgtagattggccttatcaggtttctgggtgcctctgccttaagatcctgaaggcaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacagaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacaggaataaaaaagt

SEQ ID NO: 61829 - DNA, 734 bp, Homo sapiens
agcgcgcgcccggggtgcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagaaaaa

SEQ ID NO: 61830 - DNA, 501 bp, Homo sapiens
agcgcgcgcccggggtgcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagaaaaa

SEQ ID NO: 61831 - DNA, 427 bp, Homo sapiens
atcttatgccagtgaggctgtgctgcggctgagcgggcctcccatccctcttaaaagagttaggcatttagccatgcctcccacccgggaccctttccagcagcctacattagataacgatgattcctacttaggagaactgcgggcttccaagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagaaaaa

SEQ ID NO: 61832 - DNA, 432 bp, Homo sapiens
accccgttcttgagttaaaagtctatttatttacttccttgttggagaagggcaggagagtacctgggaatcattacgatccctagcagctcatcctgccctttgaataccctcaatttacaggcttggctcagaatataccctgttgattgcctgtcgtgaggggtttgaatacaggggggaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagaaaaa

SEQ ID NO: 61833 - DNA, 1081 bp, Homo sapiens
agcgcgcgcccggggtgcgcaaccggcccaacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaattgccatataagaacccaacacaccttgctcagcagcaggaaccctggagtcggctcaactcaacccccacaattacttccatgaggcgggatgcctactattttgatcccgagataccaaaggatgacctggacttccgcttagcagccttgtacaaccaccacactgggacattcaagaacaaaagtgagatactgttaaaccagaaaaccacgcaggatacctataggtaagtggtagaggcagagcctctccagcctaaacatgctgccatccagtcatataaggtaaaatgtcacctggaaaatgataatcactaggtactcatttgtatacaaatttctgtatttttacatctgtgtctataatatagtttctgtattttcactgtctaagatgaacagaaatctcccaagattgtgctcatctgtataaacaaaatctttggttaatcccacagaggtaaaaagagtctttggctgctttattcttgagatcacattcaactaccttgccttcctcacctttctctgattgatttcactctccacttttcttccctatgccttcttctagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagaaaaa

SEQ ID NO: 61834 - DNA, 543 bp, Homo sapiens
atcttatgccagtgaggctgtgctgcggctgagcgggcctcccatccctcttaaaagagttaggcatttagccatgcctcccacccgggaccctttccagcagcctacattagataacgatgattcctacttaggagaactgcgggcttccaagataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcctggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggcccacttccattaaatagatttgtgcaagaaaaa

SEQ ID NO: 61835 - DNA, 534 bp, Homo sapiens
atcctttaagataattttctgtaaaataggctgggtttttgttgttgttgttgttttatttttataatattcctaggagaagcacttgatgagtgtttatatcattgagaacatttggcaagagaaagacaaacagtagaaccacaataccccaacatttaaggaaatgagaaagaaaacctggtattttcaccatcctctctgaaaataaatactttgacttgcactgattactacttcatcagcattcaactccgctccgtggcactctgtgtgaataattttaaaggcagattaagcattctaaaaataaattctattggtaaattaggatatcagatgcttccattataaaagcctatcctattctgtactctcagctggcagtcatatccagatctcaagctactctggctcttattgaacaagaacctattccaggagtgaggttttgaagagggatctctcatggttaactagagacagaaagaggcagaattgcccacatactctggcaggagttaaaataacaat

SEQ ID NO: 61836 - DNA, 283 bp, Homo sapiens
tatgatttctttcagcagtgttttgtaattcttcttacagagatctttcacctccttggttagataagttagatgtattcctaggaatttattttttgtgtggccatctatttggatactttctatttccttttcttgcatcattgctctggcaagaaattcagtactatgttgaataggagtggtgaaagtgagcatccttgtcttgttgcagttttcaaggggaatggttccatcttttgcccattcagtataatgttggctatgggtttgtcattgatgt

SEQ ID NO: 61837 - DNA, 262 bp, Homo sapiens
tgttttgtagagatggtgttttgccatgttgtccaggctggtggtcttctcatctataagttgaaaacacagtccttgtggggttgcttgagacacccagaggggcttcaatgcccctggtgactcagaggctttcaatgaaagtcctgggctcagggagcagacaactcccagtttgagacttgattctgccgtgcacttgctggctgacctcagaggaactggtcctctctatgccccagtttcctcacctgtaaaatgg

SEQ ID NO: 61838 - DNA, 2982 bp, Homo sapiens
  misc_feature (2120)..(2122): n is a, c, g, or t
  misc_feature (2242)..(2242): n is a, c, g, or t
  misc_feature (2934)..(2935): n is a, c, g, or t
gtggggttttgggggggcagtgggtgcaaggagtttggtttgtgtctgccggccggcaggcaaacgcaaccacgcggtgggggaggcggctagcgtggtggacggcccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaagccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggtaagctggtggggatgggtgggcacctgggtgggaggctcatggggcaaccgcagaatccaggagctggaagagccactgggactcattcattcattcattcattcatacaacatgtatttatccagtgcctactctggaccagtcactgtgctacatcagtgatacctgggtgaaccaaacagaccaaaatctcagcaactcaagcagggaggcaggcactaagcataatacatcaattctgtggtacctcagaaggtgaagggtctatgggcaaattacagcagggtaagggagactgatgttttctaagtttttgttttatgaagaaaaattaagcccagaaagcccttatttgcaggtacaattatgcagaagcccagtacataagatagataaggagctgctaggagaggggagcagagaactgaccccatggcctttgcactgctgtggaaccccagggctccagggaaccgcagtttgacaacttttgaacaagtcaccgcctgcctctcccactagcctagacaaagagctaaaggctcagagagggggaatgacttgccagagccacttaaattagtggcaggtcccagtggagggctgtttcctgaccaccctgccccctcctccaaaccacgggctctgggaaggagaggtggtgttgggaggtcttnnncaggggtgggatataactggggggcccagctgattccctccccttccactccaggcctggcctccacgcaggcacagagtgtgccggtcatcaacagcatgggcagcagcctgaccaccntgcagcccgtccagttctcccagccgctgcacccctcctaccagcagccgctcatgccacctgtgcagagccatgtgacccagaaccccttcatggccaccatggctcagctgcagagcccccacggtgagcaccctgtgccccacacagcaggagatgatgatagaggttggctgtcaatggatgcaggggaaaggggtgcctggcaggcattgcagtctgcatgtgtctctgggacaagtgtttttccgtgattgagggtgtctgcaggccagtgtgttcccatgtgaatgcacgtatctgtgtgtgtgcacgactgcttgtgtgagcagatccctagtgcgtgtctgggtgtgtatcggttgtgcatgcatttgtgtgcatgcctgtgtttctctgaaactcttagggccatatgaatttctaaaatctattcagattttagaaaggtaatctggggccaggcgtggtggctcatgcctgtaatcccagcactttggaaggccgaggtgggcagatcacttgaggtcaggagttcaagaccagcctggccaacacggtgaaaccccgtctctactaaaagtacaaaaattagccaggcgtggagcacgtgcctgtagtcccagctacttgggaggctgaggcagaatcgcttgaacctgggaggcggaggttgcagtgagctgagattnngccactgcactgcactccagcctgggcaacagagtgagtactctgcc

SEQ ID NO: 61839 - DNA, 3246 bp, Homo sapiens
  misc_feature (1506)..(1506): n is a, c, g, or t
gtggggttttgggggggcagtgggtgcaaggagtttggtttgtgtctgccggccggcaggcaaacgcaaccacgcggtgggggaggcggctagcgtggtggacggcccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaagccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccntgcagcccgtccagttctcccagccgctgcacccctcctaccagcagccgctcatgccacctgtgcagagccatgtgacccagaaccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccggcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcgggttgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctagatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaa

SEQ ID NO: 61840 - DNA, 392 bp, Homo sapiens
ggccactgcctctaggtctgaggcaaagttaacaaggatggaataaatctggatgatggccagcccaccagcttcaaggctgagattcagatcttgttggagaaggtgtggtccactggatgctggaaacatctgaggtggggcaggcttttgctggcaattaaaaaatgcccccctggggtgccaataaaagtcagtaggatggtgagtccctcatctctacgaaaaataaaaatattagctggacatactggtgtgcacctatggtcccagctacttgagaggctgaggtggaaggattgcttgaggccaggagatcaaggctgcagtgcactcactgtgtttgtaccactgcactccagcctgggcaacagaggatactgtgtctcaaa

SEQ ID NO: 61841 - DNA, 454 bp, Homo sapiens
gagacagacagcagccaagggttgaaaaactacctattgggtactatgttcactacctgggtgatggcatcggttgttcctccaaagctcagcatcacacacaacacccatgtgagaaacttgcctatgtatcccctgaaactaaaacaaaagttgaagtttaaaaaattaatacaagaaatgagctctccattcccagacacacacaaacacacgcacacacacgcaaaattttgacaccagtaagccatcatggaggaaaggatataagagggtttgaggatgctcaagtgagataaccttcttgccgattccagcccagccctcagggcctttccatggttcagcccctgcaggggtcttcttgttgggttccctgttgctccataacagtcaccaggaagcgattcagactctgagtccgtgttggcttagatgagtcatgatgagtgat

SEQ ID NO: 61842 - DNA, 475 bp, Homo sapiens
atgcctgtagcctcagctacttgggatgctgaggtgggaggatcacctgagcctggggagttcaaggctccagtgagccgtgatgtgccactacacactccagtctgggtgacagaattaaataaaattagtttcattatttaagtcaacagaaattatccaacccatcattaatcataccaagtactgaaaagaaaaaaaatgccccaatatatctagcaggtagttaagttaaaagttaccttattgcaagcaaaagttaaaagttttttaaagaagcctgagcaatatagggagaccctgtctctataaaaaatttaaagatttaaaaaaaaatggtagtgcacatctctagtctcagctacttcggaggttgaggcaggaggattgcttgaacccggcagtttgaggccgcagtgagcagtgattgtgccactgcattctagcctgagtgatagagtgagacactatatcc

SEQ ID NO: 61843 - DNA, 812 bp, Homo sapiens
tacggctaggtagcgaggctgggtgtcgagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccgttggggtgctcagcagaatgctgtaaggggacccggccaccaggatcgtattacccccccg

SEQ ID NO: 61844 - DNA, 8538 bp, Homo sapiens
  misc_feature (1)..(1): n is a, c, g, or t
  misc_feature (4)..(4): n is a, c, g, or t
nganggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattccacagtgtaccttaactgtgttatttaaagggtaaggctatccttctgtagaactgtgatatacatgcaggcaaatatcaaatccatgatgcttacatgaaatcaagagccctagtcaaagcaggggtctagaagtaagactattattagatcaaaatggccaaagaaccctcatttatagcccatttttagttggctttttaaaatttggcataaataggaagttatctattgaagagagtcttttcccctcttaaagaaagatcattaaaatggaatgtaatcaaggactggaaatgcaaggaagtcatataggac

SEQ ID NO: 61845 - DNA, 8222 bp, Homo sapiens
  misc_feature (1)..(1): n is a, c, g, or t
  misc_feature (4)..(4): n is a, c, g, or t
nganggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattcca

SEQ ID NO: 61846 - DNA, 8168 bp, Homo sapiens
  misc_feature (1)..(1): n is a, c, g, or t
  misc_feature (4)..(4): n is a, c, g, or t
nganggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattcca

SEQ ID NO: 61847 - DNA, 6815 bp, Homo sapiens
  misc_feature (1)..(1): n is a, c, g, or t
  misc_feature (4)..(4): n is a, c, g, or t
nganggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaggactcttaatgtgagatccgcactcctcatagggacccatagctccaagttgagtagcc

SEQ ID NO: 61848 - DNA, 6628 bp, Homo sapiens
atttaaagtttttattatttcatttacaaaaaaaaaaatggcatttttatgaaaaactattttccaagaaataattagaaaagtggcactggtcttacaattctgcaaatctttaatgtctggcttaatagaagacagctaggttctcacatttgcttctgtagtcaacattatgtggatgtatattgagaacacctggcatcatccagctctatagttggaaataaaagctcaagacctcacagacctcctgaatgggttttacaaatctctggggtgagtcctcagactatctgggagaactgcagctgtaagggtaatgactgtacatggaatggacctacctgggctcactgtataccctaccaccaggctctggtgggaacagttcaaaggcctgtatattccatgtttggctttgcagcattggcttatggcctaatttaatattccgagtcccaccagcccaaagcataaagggaaggtggaacaagaacaacctctctgctctcgtcccaggtatggtcactttgattgcagtgccttaggagtactctcctgtaagatacacttgactatggtgcaagcaaccatggagcaacaaatagacccactatttgtatttatccgttttggactgggccaatttggattgctggtttgactcttagaaccccttctaatatgtgagagtgaccagcctctagcaatccggctggattcatcagggttaagccagtaggtgactggccgttgagtgttgacatcctggtgctgtccctcctctgaccactagatttcagattcttaccgaagaggatgagtgatctttcttcagagcagtgctcactagatctggttatccagtggacaggatggtgtcacgatgctacttaggatgaatcttaataccaatttcccttcattcccacctagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattccacagtgtaccttaactgtgttatttaaagggtaaggctatccttctgtagaactgtgatatacatgcaggcaaatatcaaatccatgatgcttacatgaaatcaagagccctagtcaaagcaggggtctagaagtaagactattattagatcaaaatggccaaagaaccctcatttatagcccatttttagttggctttttaaaatttggcataaataggaagttatctattgaagagagtcttttcccctcttaaagaaagatcattaaaatggaatgtaatcaaggactggaaatgcaaggaagtcatataggac
